US009260522B2

(12) United States Patent
Kufer et al.

(10) Patent No.: US 9,260,522 B2
(45) Date of Patent: Feb. 16, 2016

(54) BISPECIFIC SINGLE CHAIN ANTIBODIES WITH SPECIFICITY FOR HIGH MOLECULAR WEIGHT TARGET ANTIGENS

(75) Inventors: Peter Kufer, Munich (DE); Claudia Blümel, Munich (DE); Roman Kischel, Munich (DE)

(73) Assignee: AMGEN RESEARCH (MUNICH) GMBH, Munich (DE)

( * ) Notice: Subject to any disclaimer, the term of this patent is extended or adjusted under 35 U.S.C. 154(b) by 553 days.

(21) Appl. No.: 13/122,271

(22) PCT Filed: Oct. 1, 2009

(86) PCT No.: PCT/EP2009/062794
§ 371 (c)(1),
(2), (4) Date: Jul. 14, 2011

(87) PCT Pub. No.: WO2010/037837
PCT Pub. Date: Apr. 8, 2010

(65) Prior Publication Data
US 2011/0262439 A1 Oct. 27, 2011

Related U.S. Application Data

(60) Provisional application No. 61/101,933, filed on Oct. 1, 2008.

(51) Int. Cl.
C07K 16/30 (2006.01)
C07K 16/28 (2006.01)
A61K 39/00 (2006.01)

(52) U.S. Cl.
CPC ......... *C07K 16/2809* (2013.01); *C07K 16/3069* (2013.01); *A61K 2039/505* (2013.01); *C07K 2317/31* (2013.01); *C07K 2317/34* (2013.01)

(58) Field of Classification Search
CPC .. G01N 33/505; C12N 5/0636; C12N 5/0693; C12N 5/0093; C07K 16/28; C07K 16/2809; C07K 16/30; A61K 2039/5152
USPC .................. 435/4, 7.1, 325, 352, 366, 372.3; 436/501; 530/387.1, 387.3, 388.2, 530/388.22, 388.75
See application file for complete search history.

(56) References Cited

U.S. PATENT DOCUMENTS 5,726,044 A 3/1998 Lo et al.

FOREIGN PATENT DOCUMENTS

| EP | 1 293 514 A1 | 3/2003 |
|---|---|---|
| WO | WO-99/54440 A1 | 10/1999 |
| WO | WO 2004/106381 A1 | 12/2004 |
| WO | WO-2006/125481 A1 | 11/2006 |
| WO | WO 2007/042261 A2 | 4/2007 |
| WO | WO 2008/119565 A2 | 10/2008 |
| WO | WO 2008/119566 A2 | 10/2008 |
| WO | WO 2008/119567 A2 | 10/2008 |

OTHER PUBLICATIONS

Rudikoff et al (Proc. Natl. Acad. Sci. USA. 1982; 79: 1979-1983).*
Mariuzza et al. (Annu. Rev. Biophys. Biophys. Chem. 1987; 16: 139-159).*
Giusti et al. (Proc. Natl. Acad. Sci. USA. May 1987; 84 (9): 2926-2930).*
Chien et al. (Proc. Natl. Acad. Sci. USA. Jul. 1989; 86 (14): 5532-5536).*
Caldas et al. (Mol. Immunol. May 2003; 39 (15): 941-952).*
Winkler et al. (J. Immunol. Oct, 15, 2000; 165 (8): 4505-4514).*
Vajdos et al. (J. Mol. Biol. Jul. 5, 2002; 320 (2): 415-428).*
De Pascalis et al. (J. Immunol. 2002; 169 (6): 3076-3084).*
Wu et al. (J. Mol. Biol. Nov. 19, 1999; 294 (1): 151-162).*
Casset et al. (Biochem. Biophys. Res. Commun. Jul. 18, 2003; 307 (1): 198-205).*
MacCallum et al. (J. Mol. Biol. Oct. 11, 1996; 262 (5): 732-745).*
Holm et al. (Mol. Immunol. Feb. 2007; 44 (6): 1075-1084).*
ClinicalTrials.gov archive, "Phase II Study of the BiTE® Blinatumomab (MT103) in Patients With Minimal Residual Disease of B-Precursor Acute ALL," View of NCT00560794 on Aug. 11, 2008, pp. 1-3, [XP-002572438].
Maletz K., et al., "Bispecific Single-Chain Antibodies as Effective Tools for Eliminating Epithelial Cancer Cells From Human Stem Cell Preparations by Redirected Cell Cytotoxicity," *Int. J. Cancer*, (2001), pp. 409-416, vol. 93 [XP-002301955].
Wolf, E., et al., "BiTEs: bispecific antibody constructs with unique anti-tumor activity," *DDT*, (2005), pp. 1237-1244, vol. 10 n. 18, www.drugdiscoverytoday.com.
Bühler, et al. "A bispecific diabody directed against prostate-specific membrane antigen and CD3 induces T-cell mediated lysis of prostate cancer cells," Cancer Immunol Immunother 57:43-52 (2008).
Kipriyanov, et al., "Bispecific CD3×CD19 Diabody for T Cell-Mediated Lysis of Malignant Human B Cells," Int. J. Cancer 77:763-771 (1998).
Dreier et al., T cell costimulus-independent and very efficacious inhibition of tumor growth in mice bearing subcutaneous or leukemic human B cell lymphoma xenografts by a CD19-/CD3-bispecific single-chain antibody construct, *J. Immunol.* 170(8):4397-402 (2003).
Kipriyanov et al., Bispecific tandem diabody for tumor therapy with improved antigen binding and pharmacokinetics, *J. Molec. Biol.* 293:41-56 (1999).

(Continued)

*Primary Examiner* — Stephen Rawlings
(74) *Attorney, Agent, or Firm* — Marshall, Gerstein & Borun LLP

(57) ABSTRACT

The present invention provides a method for the selection of bispecific single chain antibodies comprising a first binding domain capable of binding to an epitope of CD3 and a second binding domain capable of binding to the extracellular domain cell surface antigens with a high molecular weight extracellular domain. Moreover, the invention provides bispecific single chain antibodies produced by the use of the method of the invention, nucleic acid molecules encoding these antibodies, vectors comprising such nucleic acid molecules and methods for the production of the antibodies. Furthermore, the invention provides pharmaceutical compositions comprising bispecific single chain antibodies of the invention, medical uses of the same and methods for the treatment of diseases comprising the administration of bispecific single chain antibodies of the invention.

4 Claims, 36 Drawing Sheets

(56) References Cited

OTHER PUBLICATIONS

Figure 1:
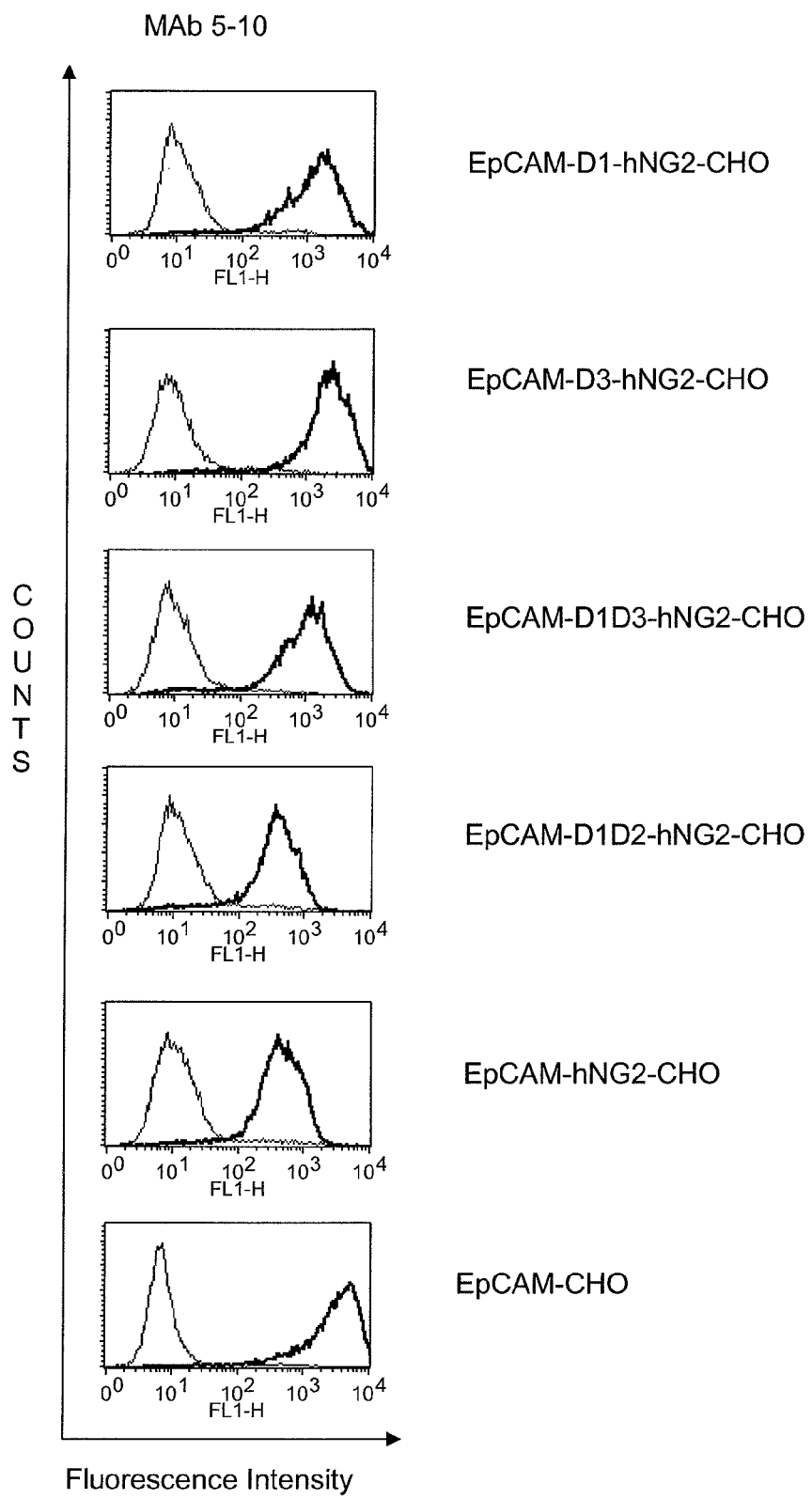

Kipriyanov et al., Effect of domain order on the activity of bacterially produced bispecific single-chain Fv antibodies, *J. Molec. Biol.* 330(1):99-111 (2003).

Loeffler et al., A recombinant bispecific single-chain antibody, CD19×CD3, induces rapid and high lymphoma-directed cytotoxicity by unstimulated T lymphocytes, *Blood* 95(6):2098-103 (2000).

Loeffler et al., Effect elimination of chronic lymphocyte leukaemia B cells by autologous T cells with a bispecific anti-CD19/ anti-CD3 single-chain antibody construct, *Leukemia* 17(5):900-9 (2003).

International Search Report and Written Opinion of the International Searching Authority, European Patent Office, PCT/EP2004/005685, dated Nov. 12, 2004.

* cited by examiner

Figure 3

```
                1                                                                             78
humanPSMA       MWNLLHETDSAVATARRPRWLCAGALVLAG-GFFLLGFLFGWFIKSSNEATNITPKHNMK-AFLDELKAENIKKFLYNFT
rat PSMA        MWNAQQDSDSAEEALGRRQRWFCAGTLVLAFTGTFIIGFLFGWFIKPSNDSTSSVSYPGMKKAFLQELKAENIKKFLYNFT
                79                                                                            158
humanPSMA       QIPHLAGTEQNFQLAKQIQSQWKEFGLDSVELAHYDVLLSYPNKTHPNYISIINEDGNEIFNTSLFEPPPGYENVSDIV
rat PSMA        RTPHLAGTQHNFELAKQIHAQWKEFGLDLVELSDYDVLLSYPNKTHPNYISIINEDGNEIFKTSLAELSPPGYENISDVV
                159                                                                           238
humanPSMA       PPFSAFSPQGMPEGDLVYVNYARTEDFFKLERDMKINCSGKIVIARYGKVFRGNKVKNAQLAGAKGVILYSDPADYFAPG
rat PSMA        PPYSAFSPQGTPEGDLVYVNYARTEDFFKLERVMKINCSGKIVIARYGQVFRGNKVKNAQLAGAKGIILYSDPADYFVPG
                239                                                                           318
humanPSMA       VKSYPDGWNLPGGGVQRGNILNLNGAGDPLTPGYPANEYAYRRGIAEAVGLPSIPVHPIGYYDAQKLLEKMGGSAPPDSS
rat PSMA        VKSYPDGWNLPGGGVQRGNVLNLNGAGDPLTPGYPANEYAYRHEFTEAVGLPSIPVHPIGYDDAQKLLEHMGGSAPPDSS
                319                                                                           398
humanPSMA       WRGSLKVPYNVGPGFTGNFSTQKVKMHIHSTNEVTRIYNVIGTLRGAVEPDRYVILGGHRDSWVFGGIDPQSGAAVVHEI
rat PSMA        WKGGLKVPYNVGPGFAGNFSKQKVKLHIHSYNKVTRIYNVIGTLKGAVEPDRYVILGGHRDAWVFGGIDPQSGAAVVHEI
                399                                                                           478
humanPSMA       VRSFGTLKKEGWRPRRTILFASWDAEEFGLLGSTEWAEENSRLLQERGVAYINADSSIEGNYTLRVDCTPLMYSLVHNLT
rat PSMA        VRTFGTLKKKGWRPRRTILFASWDAEEFGLLGSTEWAEEHSRLLQERGVAYINADSSIEGNYTLRVDCTPLMHSLVYNLT
                479                                                                           558
humanPSMA       KELKSPDEGFEGKSLYESWTKKSPSPEFSGMPRISKLGSGNDFEVFFQRLGIASGRARYTKNWETNKFSGYPLYHSVYET
rat PSMA        KELPSPDEGFEGKSLYDSWKEKSPSTEFIGMPRISKLGSGNDFEVFFQRLGIASGRARYTKNWKNNKVSSYPLYHSVYET
                559                                                                           638
humanPSMA       YELVEKFYDPMFKYHLTVAQVRGGMVFELANSIVLPFDCRDYAVVLRKYADKIYSISMKHPQEMKTYSVSFDSLFSAVKN
rat PSMA        YELVEKFYDPTFKYHLTVAQVRGAMVFELANSIVLPFDCQSYAVALKKHAETIYNISMNHPQEMKAYMISFDSLFSAVNN
                639                                                                           718
humanPSMA       FTEIASKFSERLQDFDKSNPIVLRMMNDQLMFLERAFIDPLGLPDRPFYRHVIYAPSSHNKYAGESFPGIYDALFDIESK
rat PSMA        FTDVASKFNQRLQDLDKSNPILLRILNDQLMYLERAFIDPLGLPGRPFYRHIIYAPSSHNKYAGESFPGIYDALFDINNK
                719                      750
humanPSMA       VDPSKAWGEVKRQIYVAAFTVQAAAETLSEVA
rat PSMA        VDTSKAWREVKRQISIAAFTVQAAAETLREVD
```

Figure 9

```
                   1                                                                               80
FAPalpha human     MKTWVKIVFGVATSAVLALLVMCIVLRPSRVHNSEENTMRALTLKDILNGTFSYKTFFPNWISGQEYLHQSADNNIVLYN
FAPalpha-murine    MKTWLKTVFGVTTLAALALVVICIVLRPSRVYKPEGNTKRALTLKDILNGTFSYKTYFPNWISEQEYLHQSEDDNIVFYN
                   81                                                                              160
FAPalpha human     IETGQSYTILSNRTMKSVNASNYGLSPDRQFVYLESDYSKLWRYSYTATYYIYDLSNGEFVRGNELPRPIQYLCWSPVGS
FAPalpha-murine    IETRESYIILSNSTMKSVNATDYGLSPDRQFVYLESDYSKLWRYSYTATYYIYDLQNGEFVRGYELPRPIQYLCWSPVGS
                   161                                                                             240
FAPalpha human     KLAYVYQNNIYLKQRPGDPPFQITFNGRENKIFNGIPDWVYEEEMLATKYALWSPNGKFLAYAEFNDTDIPVIAYSYYG
FAPalpha-murine    KLAYVYQNNIYLKQRPGDPPFQITYTGRENRIFNGIPDWVYEEEMLATKYALWSPDGKFLAYVEFNDSDIPIIAYSYYG
                   241                                                                             320
FAPalpha human     DEQYPRTINIPYPKAGAKNPVVRIFIDTTYPAYVGPQEVPVPAMIASSDYYFSWLTWVTDERVCLQWLKRVQNVSVLSI
FAPalpha-murine    DGQYPRTINIPYPKAGAKNPVVRFIVDTTYPHHVGPMEVPVPEMIASSDYYFSWLTWVSSERVCLQWLKRVQNVSVLSI
                   321                                                                             400
FAPalpha human     CDFREDWQTWDCPKTQEHIEESRTGWAGGFFVSTPVFSYDAISYYKIFSDKDGYKIHYIKDTVENAIQITSGKWEAINI
FAPalpha-murine    CDFREDWHAWECPKNQEHVEESRTGWAGGFFVSTPAFSQDATSYYKIFSDKDGYKIHYIKDTVENAIQITSGKWEAIYI
                   401                                                                             480
FAPalpha human     FRVTQDSLFYSSNEFEEYPGRRNIYRISIGSYPPSKKCCVTCHLRKERCQYYTASFSDYAKYYALVCYGPGIPISTLHDGR
FAPalpha-murine    FRVTQDSLFYSSNEFEGYPGRRNIYRISIGNSPPSKKCCVTCHLRKERCQYYTASFSYKAKYYALVCYGPGLPISTLHDGR
                   481                                                                             560
FAPalpha human     TDQEIKILEENKELENALKNIQLPKEEIKKLEVDEITLWYKMILPPQFDRSKKYPLLIQVYGGPCSQSVRSVFAVNWISY
FAPalpha-murine    TDQEIQVLEENKELENSLRNIQLPKVEIKKLKDGGLTFWYKMILPPQFDRSKKYPLLIQVYGGPCSQSVKSVFAVNWITY
                   561                                                                             640
FAPalpha human     LASKEGMVIALVDGRGTAFQGDKLLYAVYRKLGVYEVEDQITAVRKFIEMGFIDEKRIAIWGWSYGGYVSSLALASGTGL
FAPalpha-murine    LASKEGIVIALVDGRGTAFQGDKFLHAVYRKLGVYEVEDQLTAVRKFIEMGFIDEERIAIWGWSYGGYVSSLALASGTGL
                   641                                                                             720
FAPalpha human     FKCGIAVAPVSSWEYYASVYTERFMGLPTKDDNLEHYKNSTVMARAEYFRNVDYLLIHGTADDNVHFQNSAQIAKALVNA
FAPalpha-murine    FKCGIAVAPVSSWEYYASIYSERFMGLPTKDDNLEHYKNSTVMARAEYFRNVDYLLIHGTADDNVHFQNSAQIAKALVNA
                   721                                    760
FAPalpha human     QVDFQAMWYSDQNHGLS-GLSTNHLYTHMTHFLKQCFSLSD
FAPalpha-murine    QVDFQAMWYSDQNHGISSGRSQNHLYTHMTHFLKQCFSLSD
```

CHO transfected with a mutated human
FAPA antigen with murine membrane-distal
epitopes
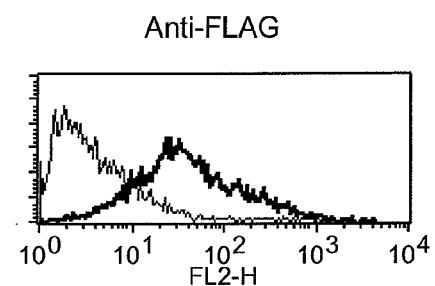
Anti-FLAG
CHO transfected with
murine FAPA
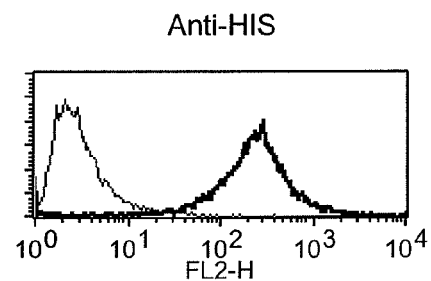
Anti-HIS
Figure 10

Effector T cells: stimulated human CD4/CD56 depleted human PBMC
Target cells: CHO transfected with human FAPA
E:T ratio: 10:1
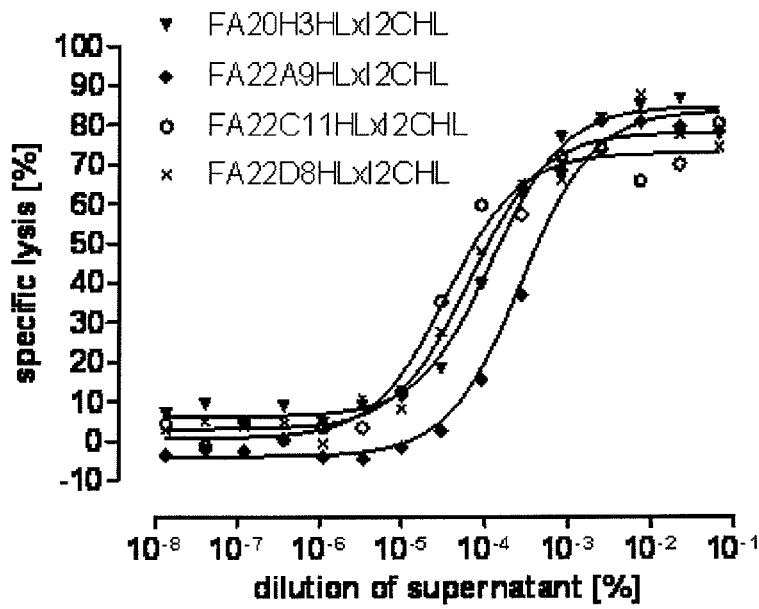
Effector T cells: stimulated human CD4/CD56 depleted human PBMC
Target cells: CHO transfected with human FAPA
E:T ratio: 10:1
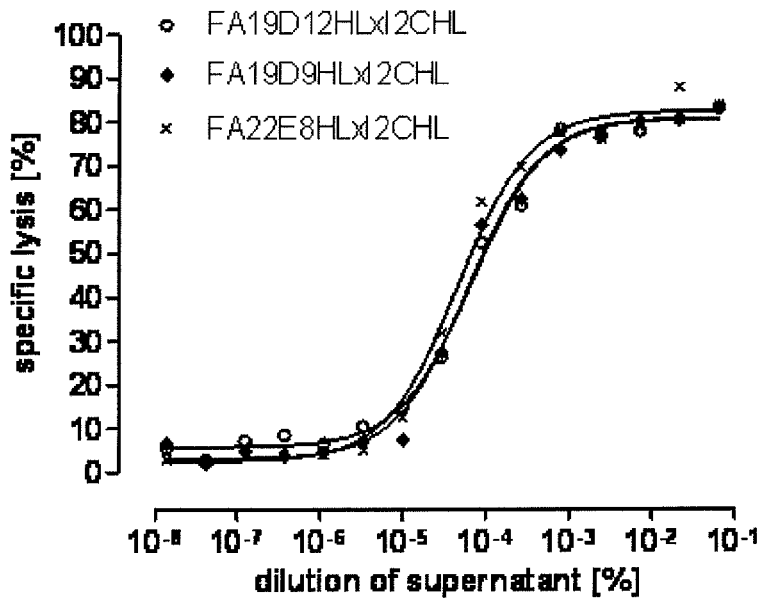
Figure 12a Effector T cells: stimulated CD4/CD56 depleted human PBMC
Target cells: CHO transfected with a mutated human FAPA antigen with murine membrane-distal epitopes
E:T ratio: 10:1
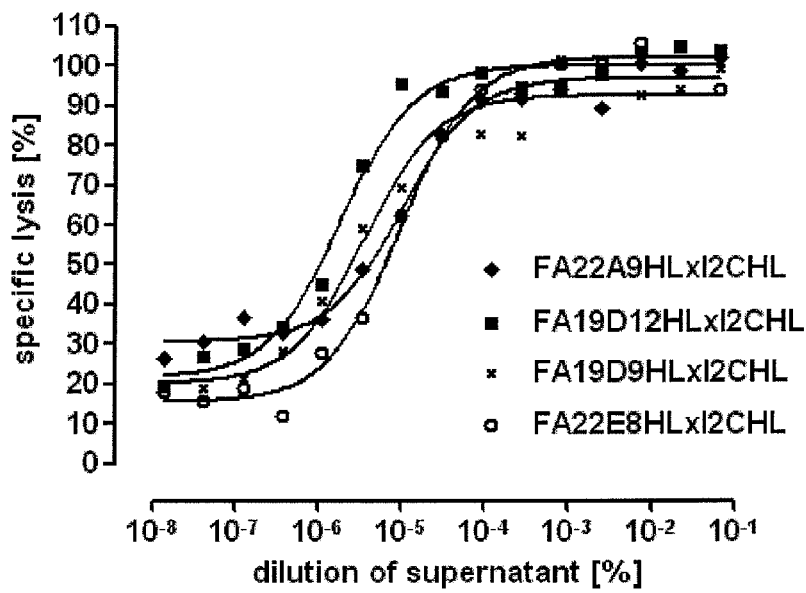
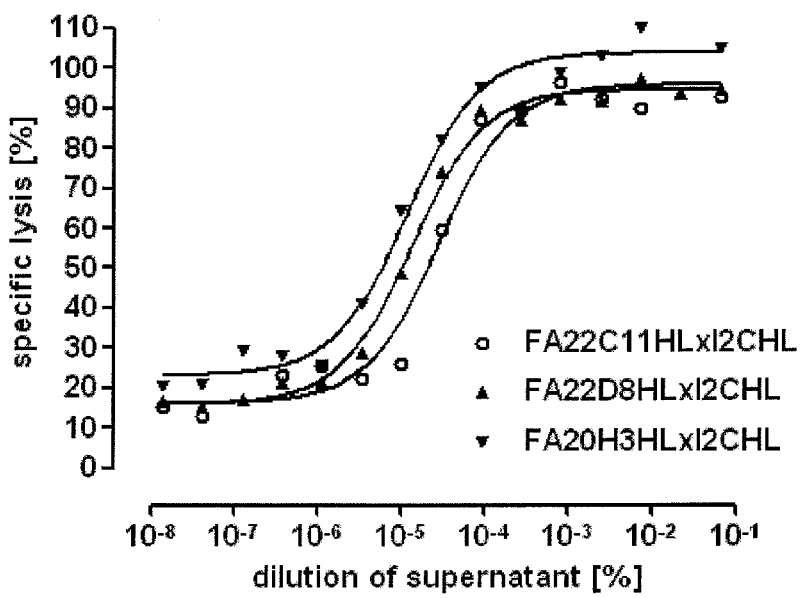
Effector T cells: stimulated CD4/CD56 depleted human PBMC
Target cells: CHO transfected with a mutated human FAPA antigen with murine membrane-distal epitopes
E:T ratio: 10:1
Figure 12b Effector T cells: stimulated CD4/CD56 depleted human PBMC
Target cells: CHO transfected with murine FAPA
E:T ratio: 10:1
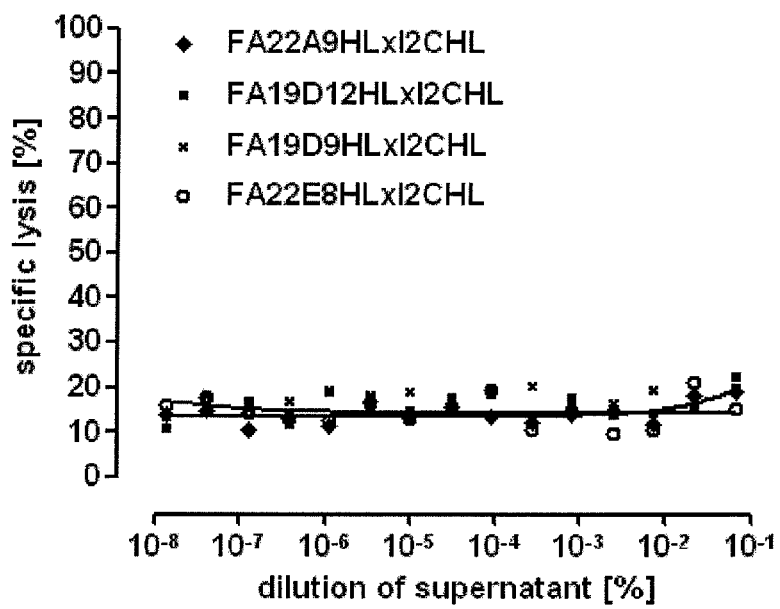
Effector T cells: stimulated CD4/CD56 depleted human PBMC
Target cells: CHO transfected with murine FAPA
E:T ratio: 10:1
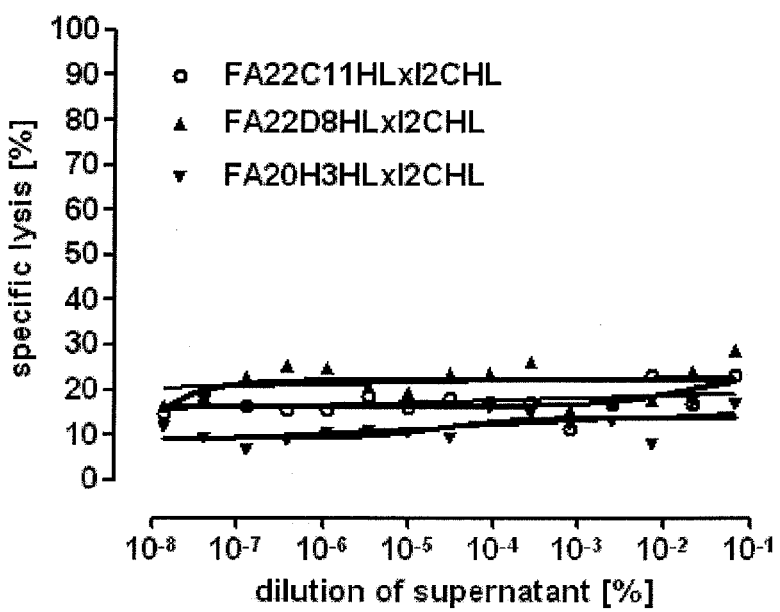
Figure 12c

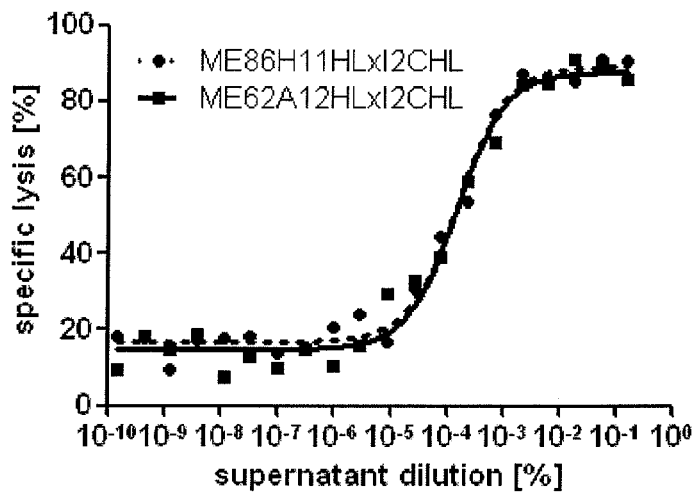
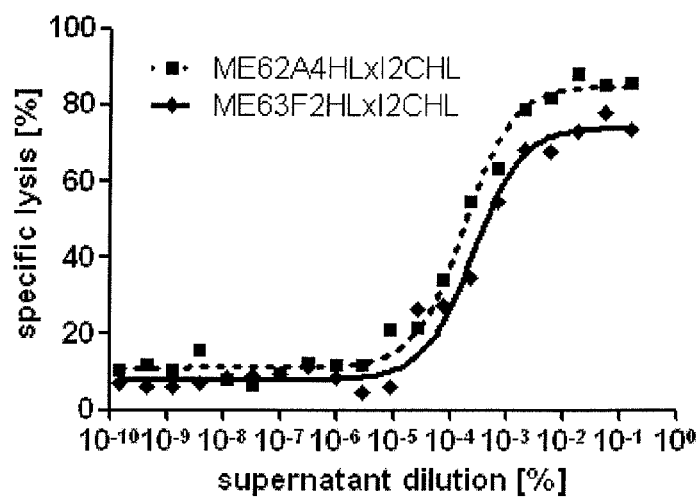
Figure 15a

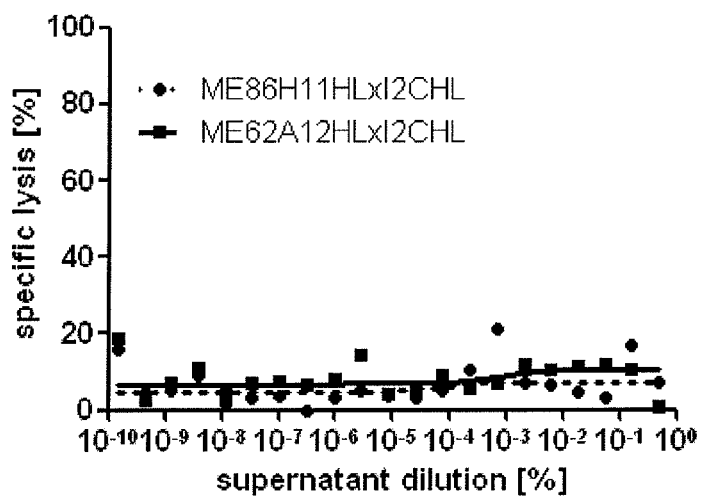
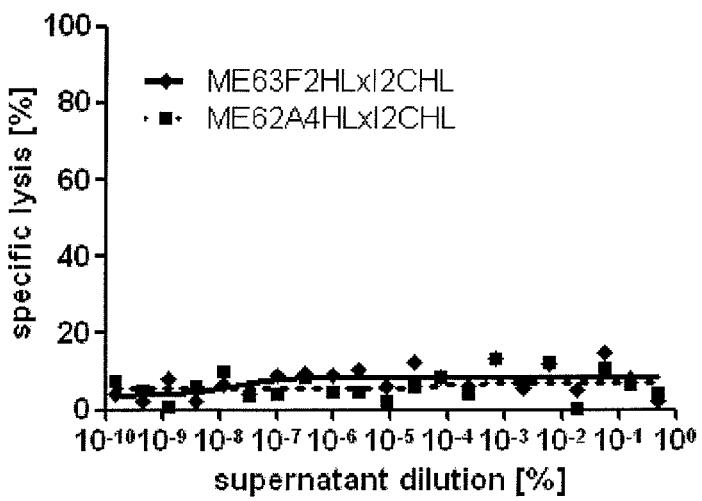
Figure 15b

Effector T cells: stimulated CD4/CD56 depleted human PBMC
Target cells: CHO transfected with the mutated murine c-MET antigen with human membrane-distal epitopes
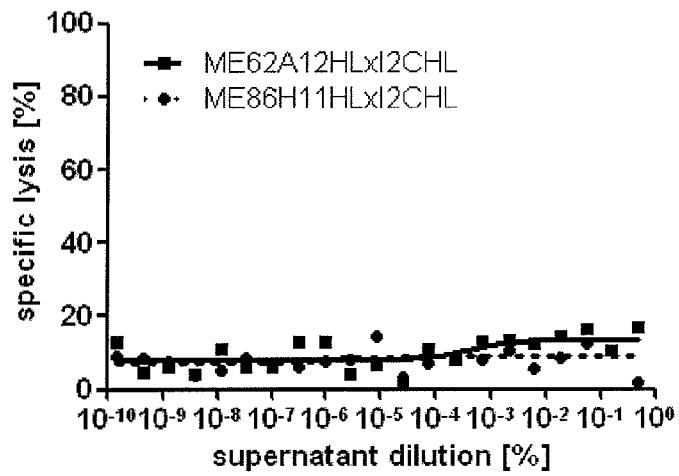
Effector T cells: stimulated CD4/CD56 depleted human PBMC
Target cells: CHO transfected with the mutated murine c-MET antigen with human membrane-distal epitopes
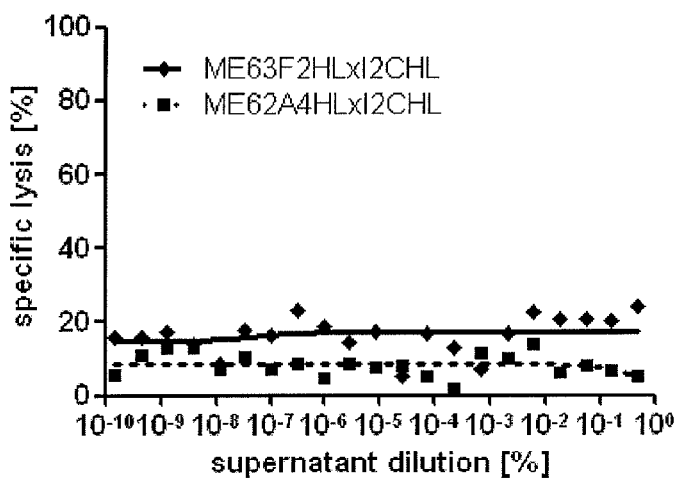
Figure 15c

BISPECIFIC SINGLE CHAIN ANTIBODIES WITH SPECIFICITY FOR HIGH MOLECULAR WEIGHT TARGET ANTIGENS

CROSS-REFERENCE TO RELATED PATENT APPLICATIONS

This application is the U.S. National Phase of PCT/EP2009/062794, filed Oct. 1, 2009, which claims priority from U.S. Provisional Application No. 61/101,933 filed Oct. 1, 2008, all which are incorporated herein by reference in entirety.

The present invention provides a method for the selection of bispecific single chain antibodies comprising a first binding domain capable of binding to an epitope of CD3 and a second binding domain capable of binding to the extracellular domain cell surface antigens with a high molecular weight extracellular domain. Moreover, the invention provides bispecific single chain antibodies produced by the use of the method of the invention, nucleic acid molecules encoding these antibodies, vectors comprising such nucleic acid molecules and methods for the production of the antibodies. Furthermore, the invention provides pharmaceutical compositions comprising bispecific single chain antibodies of the invention, medical uses of the same and methods for the treatment of diseases comprising the administration of bispecific single chain antibodies of the invention.

Unifying two antigen binding sites of different specificity into a single construct, bispecific antibodies have the ability to bring together two discrete antigens with exquisite specificity and therefore have great potential as therapeutic agents. This potential was recognized early on, leading to a number of approaches for obtaining such bispecific antibodies. Bispecific antibodies were originally made by fusing two hybridomas, each capable of producing a different immunoglobulin. The resulting hybrid-hybridoma, or quadroma, was capable of producing antibodies bearing the antigen specificity of the first parent hybridoma as well as that of the second parent hybridoma (Milstein et al., (1983) Nature 305, 537). However, the antibodies resulting from quadromas often exhibited undesired properties due to the presence of an Fc antibody portion.

Largely due to such difficulties, attempts later focused on creating antibody constructs resulting from joining two scFv antibody fragments while omitting the Fc portion present in full immunoglobulins. Each scFv unit in such constructs was made up of one variable domain from each of the heavy (VH) and light (VL) antibody chains, joined with one another via a synthetic polypeptide linker, the latter often being genetically engineered so as to be minimally immunogenic while remaining maximally resistant to proteolysis. Respective scFv units were joined by a number of techniques including incorporation of a short (usually less than 10 amino acids) polypeptide spacer bridging the two scFv units, thereby creating a bispecific single chain antibody. The resulting bispecific single chain antibody is therefore a species containing two VH/VL pairs of different specificity on a single polypeptide chain, wherein the VH and VL domains in a respective scFv unit are separated by a polypeptide linker long enough to allow intramolecular association between these two domains, and wherein the thusly formed scFv units are contiguously tethered to one another through a polypeptide spacer kept short enough to prevent unwanted association between, for example, the VH domain of one scFv unit and the VL of the other scFv unit.

Bispecific single chain antibodies of the general form described above have the advantage that the nucleotide sequence encoding the four V-domains, two linkers and one spacer can be incorporated into a suitable host expression organism under the control of a single promoter. This increases the flexibility with which these constructs can be designed as well as the degree of experimenter control during their production.

Remarkable experimental results have been obtained using such bispecific single chain antibodies designed for the treatment of malignancies (Mack, J. Immunol. (1997) 158, 3965-70; Mack, PNAS (1995) 92, 7021-5; Kufer, Cancer Immunol. Immunother. (1997) 45, 193-7; Löffler, Blood (2000) 95, 2098-103) and non-malignant diseases (Brühl, J. Immunol. (2001) 166, 2420-6); Brischwein et al. J Immunother. (2007) 30(8), 798-807; Bargou, et al. (2008) Science 321, 974). If In such bispecific single chain antibodies, one scFv unit is capable of activating cytotoxic cells, for example cytotoxic T cells, within the immune system by specifically binding to an antigen on the cytotoxic cells, while the other scFv unit specifically binds an antigen on a malignant cell intended for destruction. In this way, such bispecific single chain antibodies have been shown to activate and redirect the immune system's cytotoxic potential to the destruction of pathological, especially malignant cells. In the absence of such a bispecific single chain antibody construct, malignant cells would otherwise proliferate uninhibited.

When designing a new bispecific single chain antibodies comprising one scFv unit is capable of recruiting cytotoxic cells, for example cytotoxic T cells, while the other scFv unit specifically binds an antigen on a target cell to be eliminated by the recruited cytotoxic cell, it has been observeed that different combination of scFv's in the bispecific single chain antibodies show different effectivity in the elimination of the target cells. The election of a promising candidate is an intensive and time consuming procedure.

The present invention provides means and methods for the solution of this problem for a bispecific single chain antibodies binding with one domain to cytotoxic cells, i.e. cytotoxic T cells, and with the second binding domain to target antigens with a high molecular weight extracellular domain.

Accordingly, the present invention provides in a first embodiment a method for the selection of bispecific single chain antibodies comprising a first binding domain capable of binding to an epitope of CD3 and a second binding domain capable of binding to the extracellular domain cell surface antigens with a high molecular weight extracellular domain. Different binding domains, which may be used as first binding domain, are described in the art and in the appended sequence listing. As apparent from the above, the election of an antigenic domain on a target cell for of preparation of a target cell binding domain of a bispecific single chain antibody is the critical step for the provision of new bispecific single chain antibodies which allow for an efficient elimination of target cells via redirected T cell lysis. A first choice for the election of an antigenic domain on a target cell for of preparation of a target cell binding domain of a bispecific single chain antibody might be a domain, which is easily accessible from a steric point of view. Accordingly, the person skilled in the art would elect in the case cell surface proteins on target cells with a high molecular weight extracellular domain epitopes which are most distant from the target cell surface are most exposed, therefore best accessible for T cells and thus particularly potent in redirecting T cell cytotoxicity. However, it has been surprisingly found that membrane distant epitopes of target cell surface antigens with a high molecular weight extracellular domain show a poor potency of redirecting T cell cytotoxicity.

The method of the invention provides guidance for the election of antigenic regions of cell surface antigens with a high molecular weight extracellular domain which allow for the selection of bispecific single chain antibodies with a high potency for redirected T cell cytotoxicity. These cell surface antigens with a high molecular weight extracellular domain are type I or type II integral membrane proteins with an extracellular portion of >640 amino acids. The extracellular portion of this group of membrane proteins is independently folded, thus formed by a single continuous stretch of extracellular amino acids adjacent to the transmembrane region in the primary protein sequence. In order to fulfil the requirement of a high molecular weight extracellular domain in the context of the invention, the extracellular domain essentially comprises more than 640 amino acids. Optionally the extracellular domain is characterized by at least one functionally and/or structurally defined subdomain formed by discontinuous stretches of extracellular amino acids within the primary protein sequence. Examples for such cell surface antigens comprise prostate-specific membrane antigen (PSMA), fibroblast activation protein α (FAPα), Hepatocyte Growth Factor Receptor (c-MET), endosialin (TEM1 or CD248) and type 1 insulin-like growth factor receptor (IGF-1R).

PSMA and FAPα are cell surface molecules for which the crystal structure and, thus, the three dimensional structure of the extracellular domain are known in the art. These antigens show a compact discontinuous domain composition of the extracellular domain. It has been surprisingly found that bispecific single chain antibodies binding to epitopes with a distance of up to 60 Å from the alpha C-atom of the thirteenth extracellular amino acid as counted from the junction of transmembrane and extracellular region (reference C-atom) show a significant high efficiency in the redirected T cell lysis of target cells. In contrast thereto, the efficiency in the redirected T cell lysis of target cells of bispecific single chain antibodies binding only to epitopes with a distance of more than 60 Å from the reference C-atom is reduced and thus renders such bispecific antibodies unattractive for a clinical development.

c-MET, TEM1 and IGF-1R are cell surface molecules having a consecutive sequence of independently folded extracellular domains is formed by a corresponding sequence of continuous stretches of extracellular amino acids within the primary protein sequence. It has been surprisingly found that bispecific single chain antibodies binding to epitopes within the first 640 amino acid residues counted from the junction of transmembrane and extracellular region show a significant high efficiency in the redirected T cell lysis of target cells. In contrast thereto, the efficiency in the redirected T cell lysis of target cells of bispecific single chain antibodies binding only to epitopes within the amino acid residues above the $640^{th}$ amino acid residue counted from the junction of transmembrane and extracellular region is reduced and thus renders such bispecific antibodies unattractive for a clinical development.

Based on these findings the invention relates in one embodiment to a method for the selection of bispecific single chain antibodies comprising a first binding domain capable of binding to an epitope of CD3 and a second binding domain capable of binding to the extracellular domain of prostate-specific membrane antigen (PSMA), the method comprising the steps of:
(a) providing at least three types of host cells expressing
  (i) the wt human extracellular domain of PSMA (SEQ ID NO: 447) on the cell surface;
  (ii) a mutated form of the wt human PSMA on the cell surface, wherein the amino acid residues at positions 140, 169, 191, 308, 334, 339, 344, 624, 626, 716, 717 and 721 are mutated to the corresponding amino acid residues of the wt rodent PSMA; and
  (iii) the rodent wt extracellular domain of PSMA on the cell surface;
(b) contacting each type of host cells (i), (ii) and (iii) of step (a) with the bispecific single chain antibodies and effector T cells; and
(c) identifying and isolating the bispecific single chain antibodies that mediate the lysis of host cells expressing wt human extracellular domain of PSMA on the cell surface according to (b)(i) and of host cells expressing mutated form of the wt human PSMA on the cell surface according to (b)(ii) but not of host cells expressing the rodent wt extracellular domain of PSMA on the cell surface according to b(iii).

As noted above, prostate-specific membrane antigen (PSMA; PSM) is a large antigen falling under the provided definition of cell surface antigens with a high molecular weight extracellular domain. Israeli et al. (Cancer Res. 53: 227-230, 1993) cloned a 2.65-kb cDNA for a prostate-specific membrane antigen detected with a monoclonal antibody raised against the human prostatic carcinoma cell line LNCaP. The PSMA gene encodes a 750-amino acid protein that has an apparent molecular weight of 100 kD (due to posttranslational modification) and is expressed by normal and neoplastic prostate cells. PSMA was originally defined by the monoclonal antibody (MAb) 7E11 derived from immunization with a partially purified membrane preparation from the lymph node prostatic adenocarcinoma (LNCaP) cell line (Horoszewicz et al., Anticancer Res. 7 (1987), 927-35). A 2.65-kb cDNA fragment encoding the PSMA protein was cloned and subsequently mapped to chromosome 11p11.2 (Israeli et al., loc. cit.; O'Keefe et al., Biochem. Biophys. Acta 1443 (1998), 113-127). Initial analysis of PSMA demonstrated widespread expression within the cells of the prostatic secretory epithelium. Immunohistochemical staining demonstrated that PSMA was absent to moderately expressed in hyperplastic and benign tissues, while malignant tissues stained with the greatest intensity (Horoszewicz et al., loc. cit.). Subsequent investigations have recapitulated these results and evinced PSMA expression as a universal feature in practically every prostatic tissue examined to date. These reports further demonstrate that expression of PSMA increases precipitously proportional to tumor aggressiveness (Burger et al., Int. J. Cancer 100 (2002), 228-237; Chang et al., Cancer Res. 59 (1999), 3192-98; Chang et al., Urology 57 (2001), 1179-83), Kawakami and Nakayama, Cancer Res. 57 (1997), 2321-24; Liu et al., Cancer Res. 57 (1997), 3629-34; Lopes et al., Cancer Res. 50 (1990), 6423-29; Silver et al., Clin. Cancer Res. 9 (2003), 6357-62; Sweat et al., Urology 52 (1998), 637-40; Troyer et al., Int. J. Cancer 62 (1995), 552-558; Wright et al., Urology 48 (1996), 326-334). Consistent with the correlation between PSMA expression and tumor stage, increased levels of PSMA are associated with androgen-independent prostate cancer (PCa). Analysis of tissue samples from patients with prostate cancer has demonstrated elevated PSMA levels after physical castration or androgen-deprivation therapy. Unlike expression of prostate specific antigen, which is downregulated after androgen ablation, PSMA expression is significantly increased in both primary and metastatic tumor specimens (Kawakami et al., Wright et al., loc. cit.). Consistent with the elevated expression in androgen-independent tumors, PSMA transcription is also known to be downregulated by steroids, and administration of testosterone mediates a dramatic reduction in PSMA protein and mRNA levels (Israeli et al., Cancer Res. 54 (1994), 1807-

11; Wright et al., loc. cit.). PSMA is also highly expressed in secondary prostatic tumors and occult metastatic disease. Immunohistochemical analysis has revealed relatively intense and homogeneous expression of PSMA within metastatic lesions localized to lymph nodes, bone, soft tissue, and lungs compared with benign prostatic tissues (Chang et al. (2001), loc. cit.; Murphy et al., Cancer 78 (1996), 809-818; Sweat et al., loc. cit.). Some reports have also indicated limited PSMA expression in extraprostatic tissues, including a subset of renal proximal tubules, some cells of the intestinal brush-border membrane, and rare cells in the colonic crypts (Chang et al. (1999), Horoszewicz et al., Israeli et al. (1994), Lopes et al., Troyer et al., loc. cit.). However, the levels of PSMA in these tissues are generally two to three orders of magnitude less than those observed in the prostate (Sokoloff et al., Prostate 43 (2000), 150-157). PSMA is also expressed in the tumor-associated neovasculature of most solid cancers examined yet is absent in the normal vascular endothelium (Chang et al. (1999), Liu et al., Silver et al., loc. cit.). Although the significance of PSMA expression within the vasculature is unknown, the specificity for tumor-associated endothelium makes PSMA a potential target for the treatment of many forms of malignancy.

As apparent from SEQ ID NO: 447 the extracellular domain of PSMA comprises 707 amino acid residues. The $13^{th}$ aa as counted from the junction of transmembrane and extracellular region (reference C-atom) is a histidine. The identification of the amino acid residues to be mutated for the mutant human PSMA is described in detail in appended example 2. According to the method of the invention all amino acid residues which do not match between the mouse and the rodent extracellular domain of PSMA and which have a distance of more than 60 Å from the reference C-atom are mutatet from the human sequence to the rodent sequence. This mutation results in a transformation of all antigenic regions with a distance of more than 60 Å from the reference C-atom from the human specific form to the rodent specific form. Antibodies, e.g. bispecific antibodies which are specific for human epitopes comprising antigenic regions with a distance of more than 60 Å from the reference C-atom (specific for membrane distal epitopes) do not bind to the mutant human PSMA and the rodent PSMA. Accordingly, the method of the invention allows for a discrimination of antibodies which bind to epitopes comprising antigenic regions with a distance of more than 60 Å from the reference C-atom (antibodies specific for membrane distal epitopes) and a positive identification and isolation of antibodies specific for epitopes of the human PSMA within a distance of less than 60 Å from the reference C-atom (antibodies specific for membrane proximal epitopes).

As apparent from the appended examples it has been surprisingly observed that the distance of the epitope from the cell membrane is a critical factor for the cytotoxic potency of a bispecific single chain antibody which engages effector T cells and target cells, such as PSMA$^+$ cells. The general effect underlying the distance between the epitope, which is bound by an according bispecific single chain antibody, from the cell membrane of a target cell is exemplified in a model in the appended example 1. What came as a surprise according to this example, however, was the large extent of the loss in target cell lysis observed between a target size of 640 aa (D1) and 679 aa (D3). Despite this small difference in target size there was more loss in target cell lysis than from 679 aa (D3) to 1319 aa (D1+D3). Thus, a target size of 640 aa was unexpectedly found as upper threshold for the membrane-distant epitopes of bispecific single chain antibodies, still capable of inducing redirected T cell cytotoxicity with reasonable potency without requiring compensation for the negative influence of more membrane-distance by other properties of the bscAb such as a very high affinity to the target antigen. Moreover, the cytotoxic potency relative to the distance of the epitope bound by a bispecific single chain antibody is demonstrated in examples 3 and 4.

Examples for assays for performing the steps of the method according to the invention are described in the appended examples.

The invention further relates to a method for the selection of bispecific single chain antibodies comprising a first binding domain capable of binding to an epitope of CD3 and a second binding domain capable of binding to the extracellular domain of fibroblast activation protein α (FAPα), the method comprising the steps of:
(a) providing at least three types of host cells expressing
   (i) the wt human extracellular domain of FAPα (SEQ ID NO: 448) on the cell surface;
   (ii) a mutated form of the wt human FAPα on the cell surface, wherein the amino acid residues at positions 144, 185, 186, 229, 267, 273, 274, 278, 284, 301, 328, 329, 331, 335 and 362 are mutated to the corresponding amino acid residues of the wt rodent FAPα; and
   (iii) the rodent wt extracellular domain of FAPα on the cell surface;
(b) contacting each type of host cells (i), (ii) and (iii) of step (a) with the bispecific single chain antibodies and effector T cells; and
(c) identifying and isolating the bispecific single chain antibodies that mediate the lysis of host cells expressing wt human extracellular domain of FAPα on the cell surface according to (b)(i) and of host cells expressing mutated form of the wt human FAPα on the cell surface according to (b)(ii) but not of host cells expressing the rodent wt extracellular domain of FAPα on the cell surface according to b(iii).

Another large antigen according to the above definition is the cell surface protease fibroblast activation protein alpha (FAP alpha). In epithelial cancer, invasion and metastasis of malignant epithelial cells into normal tissues is accompanied by adaptive changes in the mesenchyme-derived supporting stroma of the target organs. Altered gene expression in these non-transformed stromal cells has been discussed to provide potential targets for therapy. FAP alpha is such an example for a target of activated tumor fibroblasts in tumor stroma. Fibroblast activation protein alpha is an inducible cell surface glycoprotein that has originally been identified in cultured fibroblasts using monoclonal antibody F19. Immunohistochemical studies have shown that FAP alpha is transiently expressed in certain normal fetal mesenchymal tissues but that normal adult tissues as well as malignant epithelial, neural, and hematopoietic cells are generally FAP alpha-negative. However, most of the common types of epithelial cancers contain abundant FAP alpha-reactive stromal fibroblasts. FAP alpha cDNA was cloned and published in Gen Bank (Accession number NM_004460). The predicted human FAP alpha protein is a type II integral membrane protein with a large C-terminal extracellular domain, which contains 6 potential N-glycosylation sites, 13 cysteine residues, and 3 segments that correspond to highly conserved catalytic domains of serine proteases; a hydrophobic transmembrane segment; and a short cytoplasmic tail. FAP-alpha shows 48% amino acid identity with dipeptidyl peptidase IV (DPP4) and 30% identity with DPP4-related protein (DPPX). Northern blot analysis detected a 2.8-kb FAP alpha mRNA in fibroblasts. Seprase is a 170-kD integral membrane gelatinase whose expression correlates with the invasiveness of human melanoma and carcinoma cells. Goldstein et al. (Biochim. Biophys. Acta 1361: 11-19, 1997) cloned and characterized the corresponding seprase cDNA. The authors found that seprase and FAP alpha are the same protein and products of the same gene. Pineiro-Sanchez et al. (J. Biol. Chem. 272: 7595-7601, 1997) isolated seprase/FAP alpha protein from the cell membranes and shed vesicles of human melanoma LOX cells. Serine protease inhibitors blocked the gelatinase activity of seprase/FAP alpha, suggesting that seprase/FAP alpha contains a catalytically active serine residue(s). The authors found that seprase/FAP alpha is composed of monomeric, N-glycosylated 97-kD subunits that are proteolytically inactive. They concluded that seprase/FAP alpha is similar to DPP4 in that their proteolytic activities are dependent upon subunit association. Due to its degrading activity of gelatine and heat-denatured type-I and type-IV collagen, a role for seprase/FAP alpha in extracellular matrix remodeling, tumor growth, and metastasis of cancers has been suggested. Moreover, seprase/FAP alpha shows a restricted expression pattern in normal tissues and a uniform expression in the supporting stroma of many malignant tumors. Therefore, seprase/FAP alpha may be used as a target for exploring the concept of tumor stroma targeting for immunotherapy of human epithelial cancer. However, though several clinical trials have been initiated to investigate seprase's/FAP alpha's role as a tumor antigen target, conventional immunotherapy approaches or inhibition of seprase/FAP alpha enzymatic activity so far did not yet result in therapeutic efficacy (see e.g. Welt et al., J. Clin. Oncol. 12:1193-203, 1994; Narra et al., Cancer Biol. Ther. 6, 1691-9, 2007; Henry et al., Clinical Cancer Research 13, 1736-1741, 2007). As apparent from SEQ ID NO: 448 the extracellular domain of FAPα comprises 734 amino acid residues. The 13$^{th}$ aa as counted from the junction of transmembrane and extracellular region (reference C-atom) is a methionine. The identification of the amino acid residues to be mutated for the mutant human FAPα is described in detail in appended example 5. According to the method of the invention all amino acid residues which do not match between the mouse and the rodent extracellular domain of FAPα and which have a distance of more than 60 Å from the reference C-atom are mutatet from the human sequence to the rodent sequence.

Moreover, the invention relates to a method for the selection of bispecific single chain antibodies comprising a first binding domain capable of binding to an epitope of CD3 and a second binding domain capable of binding to the extracellular domain of Hepatocyte Growth Factor Receptor (c-MET), endosialin (TEM1) and type 1 insulin-like growth factor receptor (IGF-1R), the method comprising the steps of:
(a) identifying the membrane proximal 640 amino acid residues of the human and the rodent homolog of the extracellular domain of c-MET, TEM1 or IGF-1R;
(b) providing host cells expressing
  (i) the human wt of the extracellular domain of the extracellular domain of c-MET (SEQ ID NO: 439), TEM1 (SEQ ID NO: 443) or IGF-1R (SEQ ID NO: 446) on the cell surface;
  (ii) a fusion protein comprising the human membrane proximal 640 amino acid residues identified in step (a) and the rodent amino acid residues >640 of c-MET, TEM1 or IGF-1R; and
  (iii) the rodent wt extracellular domain of c-MET, TEM1 or IGF-1R;
(c) contacting the host cells according to step (b) with the bispecific single chain antibodies and effector T cells; and
(d) identifying and isolating the bispecific single chain antibodies that mediate the lysis of host cells according to (b)(i) and (b)(ii) but not of host cells according to b(iii).

As described herein above, c-MET, TEM1 and IGF-1R are type I or type II integral membrane proteins with an extracellular portion of more than 640 amino acids. The consecutive sequence of the extracellular domain comprises continuous stretches of extracellular amino acids within the primary protein sequence and independently folded extracellular subdomain formed by a single continuous stretches. Hepatocyte growth factor receptor MET (C-MET) is involved in the progression and spread of numerous human cancer types. The MET oncogene, encoding the receptor tyrosin kinase (RTK) for hepatocyte growth factor (HGF) and Scatter Factor (SF), controls genetic programs leading to cell growth, invasion, and protection from apoptosis. Deregulated activation of MET is critical not only for the acquisition of tumorigenic properties but also for the achievement of the invasive phenotype (Trusolino, L. & Comoglio, P. M. (2002) Nat. Rev. Cancer 2, 289-300). The role of MET in human tumors emerged from several experimental approaches and was unequivocally proven by the discovery of MET-activating mutations in inherited forms of carcinomas (Schmidt et al., Nat. Genet. 16 (1997), 68-73; Kim et al., J. Med. Genet. 40 (2003), e97). MET constitutive activation is frequent in sporadic cancers, and several studies have shown that the MET oncogene is overexpressed in tumors of specific histotypes or is activated through autocrine mechanisms. Besides, the MET gene is amplified in hematogenous metastases of colorectal carcinomas (Di Renzo et al., Clin. Cancer Res. 1 (1995), 147-154). The Scatter Factor (SF) secreted in culture by fibroblasts, that have the ability to induce intercellular dissociation of epithelial cells, and the Hepatocyte Growth Factor (HGF), a potent mitogen for hepatocytes in culture derived from platelets or from blood of patients with acute liver failure, independently identified as Met ligands turned out to be the same molecule. Met and SF/HGF are widely expressed in a variety of tissues. The expression of Met (the receptor) is normally confined to cells of epithelial origin, while the expression of SF/HGF (the ligand) is restricted to cells of mesenchymal origin. Met is a transmembrane protein produced as a single-chain precursor. The precursor is proteolytically cleaved at a furin site to produce a highly glycosylated and entirely extracellular a-subunit of 50 kd and a β-subunit of 145 kd with a large extracellular region (involved in binding the ligand), a membrane spanning segment, and an intracellular region (containing the catalytic activity) (Giordano (1989) 339: 155-156). The α and β chains are disulphide linked. The extracellular portion of Met contains a region of homology to semaphorins (Sema domain, which includes the full α chain and the N-terminal part of the β chain of Met), a cysteine-rich Met Related Sequence (MRS) followed by glycineproline-rich (G-P) repeats, and four Immunoglobuline-like structures (Birchmeier et al., Nature Rev. 4 (2003), 915-25). The intracellular region of Met contains three regions: (1) a juxtamembrane segment that contains: (a) a serine residue (Ser 985) that, when phosphorylated by protein kinase C or by $Ca^{2+}$ calmodulin-dependent kinases downregulates the receptor kinase activity Gandino et al., J. Biol. Chem. 269 (1994), 1815-20); and (b) a tyrosine (Tyr 1003) that binds the ubiquitin ligase Cbl responsible for Met polyubiquitination, endocytosis and degradation (Peschard et al., Mal. Cell 8 (2001), 995-1004); (2) the tyrosine kinase domain that, upon receptor activation, undergoes transphosphorylation on Tyr1234 and Tyr1235; (3) the C-terminal region, which comprises two crucial tyrosines (Tyr1349 and Tyr1356) inserted in a degenerate motif that represents a multisubstrate docking site capable of recruiting several downstream adaptors containing Src homology-2 (SH2) domains Met receptor, as most Receptor Tyrosine Kinases (RTKs) use different tyrosines to bind specific signaling molecules. The two tyrosines of the docking sites have been demonstrated to be necessary and sufficient for the signal transduction both in vitro and in vivo (Maina et al., Cell 87 (1996), 531-542; Ponzetto et al., Cell 77 (1994), 261-71).

A further example for a molecule having a large extracellular domain is the tumor endothelial marker (TEM) Endosialin (=TEM1). TEMs are overexpressed during tumor angiogenesis (St. Croix et al., Science 289 (2000), 1197-1202). Despite the fact that their functions have not been characterized in detail so far, it is well established that they are strongly expressed on vascular endothelial cells in developing embryos and tumors studies (Carson-Walter et al., Cancer Res. 61: 6649-6655, 2001). Accordingly, Endosialin, a 165-kDa type I transmembrane protein, is expressed on the cell surface of tumor blood vessel endothelium in a broad range of human cancers but not detected in blood vessels or other cell types in many normal tissues. It is a C-type lectin-like molecule of 757 amino acids composed of a signal leader peptide, five globular extracellular domains (including a C-type lectin domain, one domain with similarity to the Sushi/ccp/scr pattern, and three EGF repeats), followed by a mucin like region, a transmembrane segment, and a short cytoplasmic tail (Christian et al., J. Biol. Chem. 276: 7408-7414, 2001). The Endosialin core protein carries abundantly sialylated, O-linked oligosaccharides and is sensitive to O-sialoglycoprotein endopeptidase, placing it in the group of sialomucin-like molecules. The N-terminal 360 amino acids of Endosialin show homology to thrombomodulin, a receptor involved in regulating blood coagulation, and to complement receptor C1qRp. This structural relationship indicates a function for Endosialin as a tumor endothelial receptor. Although Endosialin mRNA is ubiquitously expressed on endothelial cells in normal human and murine somatic tissues, Endosialin protein is largely restricted to the corpus luteum and highly angiogenic tissues such as the granular tissue of healing wounds or tumors (Opaysky et al., J. Biol. Chem. 276 (2001), 38795-38807; Rettig et al., PNAS 89 (1992), 10832-36). Endosialin protein expression is upregulated on tumor endothelial cells of carcinomas (breast, kidney, lung, colorectal, colon, pancreas mesothelioma), sarcomas, and neuroectodermal tumors (melanoma, glioma, neuroblastoma) (Rettig et al., loc. cit.). In addition, Endosialin is expressed at a low level on a subset of tumor stroma fibroblasts (Brady et al., J. Neuropathol. Exp. Neurol. 63 (2004), 1274-83; Opaysky et al., loc. cit.). Because of its restricted normal tissue distribution and abundant expression on tumor endothelial cells of many different types of solid tumors, Endosialin has been discussed as a target for antibody-based antiangiogenic treatment strategies of cancer. However, so far, there are no effective therapeutic approaches using Endosialin as a tumor endothelial target.

A still further example for a large antigen is the insulin-like growth factor I receptor (IGF-IR or IGF-1R). IGF-IR is a receptor with tyrosine kinase activity having 70% homology with the insulin receptor IR. IGF-IR is a glycoprotein of molecular weight approximately 350,000. It is a hetero-tetrameric receptor of which each half-linked by disulfide bridges-is composed of an extracellular a-subunit and of a transmembrane [beta]-subunit. IGF-IR binds IGF I and IGF II with a very high affinity but is equally capable of binding to insulin with an affinity 100 to 1000 times less. Conversely, the IR binds insulin with a very high affinity although the ICFs only bind to the insulin receptor with a 100 times lower affinity. The tyrosine kinase domain of IGF-IR and of IR has a very high sequence homology although the zones of weaker homology respectively concern the cysteine-rich region situated on the alpha-subunit and the C-terminal part of the [beta]-subunit. The sequence differences observed in the a-subunit are situated in the binding zone of the ligands and are therefore at the origin of the relative affinities of IGF-IR and of IR for the IGFs and insulin respectively. The differences in the C-terminal part of the [beta]-subunit result in a divergence in the signalling pathways of the two receptors; IGF-IR mediating mitogenic, differentiation and antiapoptosis effects, while the activation of the IR principally involves effects at the level of the metabolic pathways (Baserga et al., Biochim. Biophys. Acta, 1332: F105-126, 1997; Baserga R., Exp. Cell. Res., 253:1-6, 1999). The cytoplasmic tyrosine kinase proteins are activated by the binding of the ligand to the extracellular domain of the receptor. The activation of the kinases in its turn involves the stimulation of different intracellular substrates, including IRS-1, IRS-2, Shc and Grb 10 (Peruzzi F. et al., J. Cancer Res. Clin. Oncol., 125:166-173, 1999). The two major substrates of IGF-IR are IRS and Shc which mediate, by the activation of numerous effectors downstream, the majority of the growth and differentiation effects connected with the attachment of the IGFs to this receptor. The availability of substrates can consequently dictate the final biological effect connected with the activation of the IGF-IR. When IRS-1 predominates, the cells tend to proliferate and to transform. When Shc dominates, the cells tend to differentiate (Valentinis B. et al.; J. Biol. Chem. 274:12423-12430, 1999). It seems that the route principally involved for the effects of protection against apoptosis is the phosphatidyl-inositol 3-kinases (PI 3-kinases) route (Prisco M. et al., Norm. Metab. Res., 31:80-89, 1999; Peruzzi F. et al., J. Cancer Res. Clin. Oncol., 125:166-173, 1999). The role of the IGF system in carcinogenesis has become the subject of intensive research in the last ten years. This interest followed the discovery of the fact that in addition to its mitogenic and antiapoptosis properties, IGF-IR seems to be required for the establishment and the maintenance of a transformed phenotype. In fact, it has been well established that an overexpression or a constitutive activation of IGF-IR leads, in a great variety of cells, to a growth of the cells independent of the support in media devoid of fetal calf serum, and to the formation of tumors in nude mice. This in itself is not a unique property since a great variety of products of overexpressed genes can transform cells, including a good number of receptors of growth factors. However, the crucial discovery which has clearly demonstrated the major role played by, IGF-IR in the transformation has been the demonstration that the R-cells, in which the gene coding for IGF-IR has been inactivated, are totally refractory to transformation by different agents which are usually capable of transforming the cells, such as the E5 protein of bovine papilloma virus, an overexpression of EGFR or of PDGFR, the T antigen of SV 40, activated ras or the combination of these two last factors (Sell C. et al., Proc. Natl. Acad. Sci., USA, 90: 11217-11221, 1993; Sell C. et al., Mol. Cell. Biol., 14:3604-3612, 1994; Morrione A. J., Virol., 69:5300-5303, 1995; Coppola D. et al., Mol. Cell. Biol., 14:458a-4595, 1994; DeAngelis T et al., J. Cell. Physiol., 164:214-221, 1995). IGF-IR is expressed in a great variety of tumors and of tumor lines and the IGFs amplify the tumor growth via their attachment to IGF-IR. Other arguments in favor of the role of IGF-IR in carcinogenesis come from studies using murine monoclonal antibodies directed against the receptor or using negative dominants of IGF-IR. In effect, murine monoclonal antibodies directed against IGF-IR inhibit the proliferation of numerous cell lines in culture and the growth of tumor cells in vivo (Arteaga C. et al., Cancer Res., 49:6237-6241, 1989 Li et al., Biochem. Biophys. Res. Com., 196:92-98, 1993; Zia F et al., J. Cell. Biol., 24:269-275, 1996; Scotlandi K et al., Cancer Res., 58:4127-4131, 1998). It has likewise been shown in the works of Jiang et al. (Oncogene, 18:6071-6077, 1999) that a negative dominant of IGF-IR is capable of inhibiting tumor proliferation.

The term "cell surface antigen" as used herein denotes a molecule, which is displayed on the surface of a cell. In most cases, this molecule will be located in or on the plasma membrane of the cell such that at least part of this molecule remains accessible from outside the cell in tertiary form. A non-limiting example of a cell surface molecule, which is located in the plasma membrane is a transmembrane protein comprising, in its tertiary conformation, regions of hydrophilicity and hydrophobicity. Here, at least one hydrophobic region allows the cell surface molecule to be embedded, or inserted in the hydrophobic plasma membrane of the cell while the hydrophilic regions extend on either side of the plasma membrane into the cytoplasm and extracellular space, respectively. Non-limiting examples of cell surface molecules which are located on the plasma membrane are proteins which have been modified at a cysteine residue to bear a palmitoyl group, proteins modified at a C-terminal cysteine residue to bear a farnesyl group or proteins which have been modified at the C-terminus to bear a glycosyl phosphatidyl inositol ("GPI") anchor. These groups allow covalent attachment of proteins to the outer surface of the plasma membrane, where they remain accessible for recognition by extracellular molecules such as antibodies. Examples of cell surface antigens are CD3 (in particular CD3ε), PSMA, FAPα, c-MET, endosialin and IGF-IR. As described herein above, PSMA, FAPα, c-MET, endosialin and IGF-IR are cell surface antigens which are targets for therapy of cancer, including, but not limited to solid tumors.

In light of this, the target antigens PSMA, FAPα, c-MET, endosialin and IGF-IR can also be characterized as tumor antigens. The term "tumor antigen" as used herein may be understood as those antigens that are presented on tumor cells. These antigens can be presented on the cell surface with an extracellular part, which is often combined with a transmembrane and cytoplasmic part of the molecule. These antigens can sometimes be presented only by tumor cells and never by the normal ones. Tumor antigens can be exclusively expressed on tumor cells or might represent a tumor specific mutation compared to normal cells. In this case, they are called tumor-specific antigens. More common are antigens that are presented by tumor cells and normal cells, and they are called tumor-associated antigens. These tumor-associated antigens can be overexpressed compared to normal cells or are accessible for antibody binding in tumor cells due to the less compact structure of the tumor tissue compared to normal tissue.

In accordance with the present invention an independently folded protein domain is defined as a discrete portion of a protein formed by a single continuous stretch of amino acids within the primary protein sequence, e.g. known from its crystal structure, to take the "correct conformation" without requiring support by other portions of the protein or predicted to do so by comparison with hidden Markow models in libraries of described sequence domains, such as PFAM (Bateman (2000) Nucleic Acids Res. 28: 263-266) and SMART (Schultz (2000) Nucleic Acids Res. 28: 231-234), sequence similarity searches in data bases with the BLAST and PSI-BLAST tools (Altschul (1997) Nucleic Acids Res. 25: 3389-3402) that rely on the concept of a common evolutionary ancestor among sequentially homologous sequences or any other state-of-the-art domain prediction method. Independently folded domains of the same protein chain are often joined by a flexible segment of amino acids, with each half of the flexible segment counting to its adjacent independently folded protein domain. Independently folded domains of the same protein may be connected in a precursor molecule by a protease cleavage site and after proteolytical processing may lie on two different connected protein chains in the mature molecule. Independently folded protein domains may comprise functionally and/or structurally defined subdomains which do not take their correct conformation without requiring support by other portions of the protein because they are formed by discontinuous stretches of extracellular amino acids within the primary protein sequence or kept in their correct conformation by adjacent or other portions of the protein.

Ther term "method for the selection", respectively the term "selecting" denotes in the context of the present invention the identification and isolation of one or more bispecific single chain antibodies from a population of candidate antibodies. In particular, the candidate antibodies are tested in separate settings for the binding and the mediation of cytotoxicity for each of the three different host cell populations. Populations of bispecific single chain antibodies to be tested and methods for the generation of such populations are described in the appended examples. Since the method of the invention allows for the isolation of one or more bispecific single chain antibodies the method is also understood as a method for the production of bispecific single chain antibodies of the invention. Of course, such method for the production involves the production of the population of bispecific single chain antibodies, from which the one or more, which bind to the membrane proximal epitopes, are isolated.

As used herein, a "bispecific single chain antibody" denotes a single polypeptide chain comprising two binding domains. Each binding domain comprises one variable region from an antibody heavy chain ("VH region"), wherein the VH region of the first binding domain specifically binds to the CD3 molecule, and the VH region of the second binding domain specifically binds to the extracellular domain of a membrane protein on a target cell, e.g. to PSMA, FAPα, c-MET, endosialin/TEM1 or IGF-1R. The two binding domains are optionally linked to one another by a short polypeptide spacer. A non-limiting example for a polypeptide spacer is Gly-Gly-Gly-Gly-Ser (G-G -G-G-S) and repeats thereof. Each binding domain may additionally comprise one variable region from an antibody light chain ("VL region"), the VH region and VL region within each of the first and second binding domains being linked to one another via a polypeptide linker, for example of the type disclosed and claimed in EP 623679 B1, but in any case long enough to allow the VH region and VL region of the first binding domain and the VH region and VL region of the second binding domain to pair with one another such that, together, they are able to specifically bind to the respective first and second binding domains.

The term "protein" is well known in the art and describes biological compounds. Proteins comprise one or more amino acid chains (polypeptides), whereby the amino acids are bound among one another via a peptide bond. The term "polypeptide" as used herein describes a group of molecules, which consists of more than 30 amino acids. In accordance with the invention, the group of polypeptides comprises "proteins" as long as the proteins consist of a single polypeptide chain. Also in line with the definition the term "polypeptide" describes fragments of proteins as long as these fragments consist of more than 30 amino acids. Polypeptides may further form multimers such as dimers, trimers and higher oligomers, i.e. consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "polypeptide" and "protein" also refer to naturally modified polypeptides/proteins wherein the modification is effected e.g. by post-translational modifications like glycosylation, acetylation, phosphorylation and the like. Such modifications are well known in the art.

The term "binding domain" characterizes in connection with the present invention a domain of a polypeptide which specifically binds to/interacts with a given target structure/antigen/epitope. Thus, the binding domain is an "antigen-interaction-site". The term "antigen-interaction-site" defines, in accordance with the present invention, a motif of a polypeptide, which is able to specifically interact with a specific antigen or a specific group of antigens, e.g. the identical antigen in different species. Said binding/interaction is also understood to define a "specific recognition". The term "specifically recognizing" means in accordance with this invention that the antibody molecule is capable of specifically interacting with and/or binding to at least two, preferably at least three, more preferably at least four amino acids of an antigen, e.g. the human CD3 antigen and the target antigens as defined herein. Such binding may be exemplified by the specificity of a "lock-and-key-principle". Thus, specific motifs in the amino acid sequence of the binding domain and the antigen bind to each other as a result of their primary, secondary or tertiary structure as well as the result of secondary modifications of said structure. The specific interaction of the antigen-interaction-site with its specific antigen may result as well in a simple binding of said site to the antigen. Moreover, the specific interaction of the binding domain/antigen-interaction-site with its specific antigen may alternatively result in the initiation of a signal, e.g. due to the induction of a change of the conformation of the antigen, an oligomerization of the antigen, etc.

The term "antibody" comprises derivatives or functional fragments thereof which still retain the binding specificity. Techniques for the production of antibodies are well known in the art and described, e.g. in Harlow and Lane "Antibodies, A Laboratory Manual", Cold Spring Harbor Laboratory Press, 1988 and Harlow and Lane "Using Antibodies: A Laboratory Manual" Cold Spring Harbor Laboratory Press, 1999. The term "antibody" also comprises immunoglobulins (Ig's) of different classes (i.e. IgA, IgG, IgM, IgD and IgE) and subclasses (such as IgG1, IgG2 etc.).

The definition of the term "antibody" also includes embodiments such as chimeric, single chain and humanized antibodies, as well as antibody fragments, like, inter alia, Fab fragments. Antibody fragments or derivatives further comprise F(ab')$_2$, Fv, scFv fragments or single domain antibodies, single variable domain antibodies or immunoglobulin single variable domain comprising merely one variable domain, which might be VH or VL, that specifically bind to an antigen or epitope independently of other V regions or domains; see, for example, Harlow and Lane (1988) and (1999), loc. cit. Such immunoglobulin single variable domain encompasses not only an isolated antibody single variable domain polypeptide, but also larger polypeptides that comprise one or more monomers of an antibody single variable domain polypeptide sequence.

Various procedures are known in the art and may be used for the production of such antibodies and/or fragments. Thus, the (antibody) derivatives can also be produced by peptidomimetics. Further, techniques described for the production of single chain antibodies (see, inter alia, U.S. Pat. No. 4,946,778) can be adapted to produce single chain antibodies specific for elected polypeptide(s). Also, transgenic animals may be used to express humanized or human antibodies specific for polypeptides and fusion proteins of this invention. For the preparation of monoclonal antibodies, any technique, providing antibodies produced by continuous cell line cultures can be used. Examples for such techniques include the hybridoma technique (Kohler and Milstein Nature 256 (1975), 495-497), the trioma technique, the human B-cell hybridoma technique (Kozbor, Immunology Today 4 (1983), 72) and the EBV-hybridoma technique to produce human monoclonal antibodies (Cole et al., Monoclonal Antibodies and Cancer Therapy, Alan R. Liss, Inc. (1985), 77-96). Surface plasmon resonance as employed in the BIAcore® system can be used to increase the efficiency of phage antibodies which bind to an epitope of a target polypeptide, such as CD3 (epsilon), PSMA or FAPα, c-MET, TEM1 or IGF-1R (Schier, Human Antibodies Hybridomas 7 (1996), 97-105; Malmborg, J. Immunol. Methods 183 (1995), 7-13). It is also envisaged in the context of this invention that the term "antibody" comprises antibody constructs, which may be expressed in a host as described herein below, e.g. antibody constructs which may be transfected and/or transduced via, inter alia, viruses or plasmid vectors.

The term "specific interaction" as used in accordance with the present invention means that the binding domain does not or does not significantly cross-react with polypeptides which have similar structure as those bound by the binding domain, and which might be expressed by the same cells as the polypeptide of interest. Cross-reactivity of a panel of binding domains under investigation may be tested, for example, by assessing binding of said panel of binding domains under conventional conditions (see, e.g., Harlow and Lane, Antibodies: A Laboratory Manual, Cold Spring Harbor Laboratory Press, 1988 and Using Antibodies: A Laboratory Manual, Cold Spring Harbor Laboratory Press, 1999). Examples for the specific interaction of a binding domain with a specific antigen comprise the specificity of a ligand for its receptor. Said definition particularly comprises the interaction of ligands, which induce a signal upon binding to its specific receptor. Examples for said interaction, which is also particularly comprised by said definition, is the interaction of an antigenic determinant (epitope) with the binding domain (antigenic binding site) of an antibody.

According to a preferred embodiment of the method of the invention the first binding domain binds to CD3 epsilon (CD3ε) of human and non-chimpanzee primate. In this context it is particularly preferred that the first binding domain capable of binding to an epitope of human and non-chimpanzee primate CD3ε chain binds to an epitope, which is part of an amino acid sequence comprised in the group consisting of SEQ ID NOs. 2, 4, 6, and 8.

As used herein, "human" and "man" refers to the species *Homo sapiens*. As far as the medical uses of the constructs described herein are concerned, human patients are to be treated with the same molecule.

The term "human" antibody as used herein is to be understood as meaning that the bispecific single chain antibody as defined herein, comprises (an) amino acid sequence(s) contained in the human germline antibody repertoire. For the purposes of definition herein, said bispecific single chain antibody may therefore be considered human if it consists of such (a) human germline amino acid sequence(s), i.e. if the amino acid sequence(s) of the bispecific single chain antibody in question is (are) identical to (an) expressed human germline amino acid sequence(s). A bispecific single chain antibody as defined herein may also be regarded as human if it consists of (a) sequence(s) that deviate(s) from its (their) closest human germline sequence(s) by no more than would be expected due to the imprint of somatic hypermutation. Additionally, the antibodies of many non-human mammals, for example rodents such as mice and rats, comprise VH CDR3 amino acid sequences which one may expect to exist in the expressed human antibody repertoire as well. Any such sequence(s) of human or non-human origin which may be expected to exist in the expressed human repertoire would also be considered "human" for the purposes of the present invention.

Though T cell-engaging bispecific single chain antibodies described in the art have great therapeutic potential for the treatment of malignant diseases, most of these bispecific molecules are limited in that they are species specific and recognize only human antigen, and—due to genetic similarity—likely the chimpanzee counterpart. The advantage of the preferred embodiment of the invention is the provision of a bispecific single chain antibody comprising a binding domain exhibiting cross-species specificity to human and non-chimpanzee primate of the CD3 epsilon chain.

Herein described examples for preferred first binding domains bind to an N-terminal 1-27 amino acid residue polypeptide fragment of the extracellular domain of CD3 epsilon. This 1-27 amino acid residue polypeptide fragment was surprisingly identified which—in contrast to all other known epitopes of CD3 epsilon described in the art—maintains its three-dimensional structural integrity when taken out of its native environment in the CD3 complex (and optionally fused to a heterologous amino acid sequence such as EpCAM or an immunoglobulin Fc part).

The present invention, therefore, provides for a bispecific single chain antibody molecule comprising a first binding domain capable of binding to an epitope of an N-terminal 1-27 amino acid residue polypeptide fragment of the extracellular domain of CD3 epsilon (which CD3 epsilon is, for example, taken out of its native environment and/or comprised by (presented on the surface of) a T-cell) of human and at least one non-chimpanzee primate CD3 epsilon chain, wherein the epitope is part of an amino acid sequence comprised in the group consisting of SEQ ID NOs. 2, 4, 6, and 8; and a second binding domain capable of binding to prostate-specific membrane antigen (PSMA). Preferred non-chimpanzee primates are mentioned herein elsewhere. At least one (or a selection thereof or all) primate(s) selected from *Callithrix jacchus; Saguinus oedipus, Saimiri sciureus*, and *Macaca fascicularis* (either SEQ ID 863 or 864 or both), is (are) particularily preferred. *Macaca mulatta*, also known as Rhesus Monkey is also envisaged as another preferred primate. It is thus envisaged that antibodies of the invention bind to (are capable of binding to) the context independent epitope of an N-terminal 1-27 amino acid residue polypeptide fragment of the extracellular domain of CD3 epsilon of human and *Callithrix jacchus, Saguinus oedipus, Saimiri sciureus*, and *Macaca fascicularis* (either SEQ ID 863 or 864 or both), and optionally also to *Macaca mulatta*. A bispecific single chain antibody molecule comprising a first binding domain as defined herein can be obtained (is obtainable by) or can be manufactured in accordance with the protocol set out in the appended Examples (in particular Example 2). To this end, it is envisaged to (a) immunize mice with an N-terminal 1-27 amino acid residue polypeptide fragment of the extracellular domain of CD3 epsilon of human and/or Saimiri sciureus; (b) generation of an immune murine antibody scFv library; (c) identification of CD3 epsilon specific binders by testing the capability to bind to at least SEQ ID NOs. 2, 4, 6, and 8.

The context-independence of the CD3 epitope provided herein corresponds to the first 27 N-terminal amino acids of CD3 epsilon or functional fragments of this 27 amino acid stretch. The phrase "context-independent," as used herein in relation to the CD3 epitope means that binding of the herein described inventive binding molecules/antibody molecules does not lead to a change or modification of the conformation, sequence, or structure surrounding the antigenic determinant or epitope. In contrast, the CD3 epitope recognized by a conventional CD3 binding molecule (e.g. as disclosed in WO 99/54440 or WO 04/106380) is localized on the CD3 epsilon chain C-terminally to the N-terminal 1-27 amino acids of the context-independent epitope, where it only takes the correct conformation if it is embedded within the rest of the epsilon chain and held in the right sterical position by heterodimerization of the epsilon chain with either the CD3 gamma or delta chain. Anti-CD3 binding domains as part of bispecific single chain molecules as provided herein and generated (and directed) against a context-independent CD3 epitope provide for a surprising clinical improvement with regard to T cell redistribution and, thus, a more favourable safety profile. Without being bound by theory, since the CD3 epitope is context-independent, forming an autonomous self sufficient subdomain without much influence on the rest of the CD3 complex, the CD3 binding domain of the bispecific single chain molecules provided herein induces less allosteric changes in CD3 conformation than the conventional CD3 binding molecules (like molecules provided in WO 99/54440 or WO 04/106380), which recognize context-dependent CD3 epitopes.

The context-independence of the CD3 epitope which is recognized by the CD3 binding domain of the bispecific single chain antibodies of the invention, respectively isolated by the method of the invention, is associated with less or no T cell redistribution (T cell redistribution equates with an initial episode of drop and subsequent recovery of absolute T cell counts) during the starting phase of treatment with said bispecific single chain antibody. This results in a better safety profile of the bispecific single chain antibodies of the invention compared to conventional CD3 binding molecules known in the art, which recognize context-dependent CD3 epitopes. Particularly, because T cell redistribution during the starting phase of treatment with CD3 binding molecules is a major risk factor for adverse events, like CNS adverse events, the bispecific single chain antibodies of the invention by recognizing a context-independent rather than a context-dependent CD3 epitope has a substantial safety advantage over the CD3 binding molecules known in the art. Patients with such CNS adverse events related to T cell redistribution during the starting phase of treatment with conventional CD3 binding molecules usually suffer from confusion and disorientation, in some cases also from urinary incontinence. Confusion is a change in mental status in which the patient is not able to think with his or her usual level of clarity. The patient usually has difficulties to concentrate and thinking is not only blurred and unclear but often significantly slowed down. Patients with CNS adverse events related to T cell redistribution during the starting phase of treatment with conventional CD3 binding molecules may also suffer from loss of memory. Frequently, the confusion leads to the loss of ability to recognize people, places, time or the date. Feelings of disorientation are common in confusion, and the decision-making ability is impaired. CNS adverse events related to T cell redistribution during the starting phase of treatment with conventional CD3 binding molecules may further comprise blurred speech and/or word finding difficulties. This disorder may impair both, the expression and understanding of language as well as reading and writing. Besides urinary incontinence, vertigo and dizziness may also accompany CNS adverse events related to T cell redistribution during the starting phase of treatment with conventional CD3 binding molecules in some patients. The maintenance of the three-dimensional structure within the mentioned 27 amino acid N-terminal polypeptide fragment of CD3 epsilon can be used for the generation of, preferably human, binding domains which are capable of binding to the N-terminal CD3 epsilon polypeptide fragment in vitro and to the native (CD3 epsilon subunit of the) CD3 complex on T cells in vivo with the same binding affinity. These data strongly indicate that the N-terminal fragment as described herein forms a tertiary conformation, which is similar to its structure normally existing in vivo. A very sensitive test for the importance of the structural integrity of the amino acids 1-27 of the N-terminal polypeptide fragment of CD3 epsilon was performed. Individual amino acids of amino acids 1-27 of the N-terminal polypeptide fragment of CD3 epsilon were changed to alanine (alanine scanning) to test the sensitivity of the amino acids 1-27 of the N-terminal polypeptide fragment of CD3 epsilon for minor disruptions.

Unexpectedly, it has been found that the thus isolated, preferably human, bispecific single chain antibody of the invention not only recognizes the human N-terminal fragment of CD3 epsilon, but also the corresponding homologous fragments of CD3 epsilon of various primates, including New-World Monkeys (*Marmoset, Callithrix jacchus; Saguinus oedipus; Saimiri sciureus*) and Old-World Monkeys (*Macaca fascicularis*, also known as Cynomolgus Monkey; or *Macaca mulatta*, also known as Rhesus Monkey). Thus, multi-primate specificity of the bispecific single chain antibodies of the invention can be detected. The multi-primate specificity of the biding domains of the invention is defined herein as cross-species specificity.

The amino acid sequence of the aforementioned N-terminal fragments of CD3 epsilon are depicted in SEQ ID No. 2 (human), SEQ ID No. 4 (*Callithrix jacchus*); SEQ ID No. 6 (*Saguinus oedipus*); SEQ ID No. 8 (*Saimiri sciureus*); SEQ ID No. 863 QDGNEEMGSITQTPYQVSISGTTILTC or SEQ ID No. 864 QDGNEEMGSITQTPYQVSISGTTVILT (*Macaca fascicularis*, also known as Cynomolgus Monkey), and SEQ ID No. 865 QDGNEEMGSITQTPYHVSISGT-TVILT (*Macaca mulatta*, also known as Rhesus Monkey).

The term "cross-species specificity" or "interspecies specificity" as used herein means binding of a binding domain described herein to the same target molecule in humans and non-chimpanzee primates. Thus, "cross-species specificity" or "interspecies specificity" is to be understood as an interspecies reactivity to the same molecule "X" expressed in different species, but not to a molecule other than "X". Cross-species specificity of a monoclonal antibody recognizing e.g. human CD3 epsilon, to a non-chimpanzee primate CD3 epsilon, e.g. macaque CD3 epsilon, can be determined, for instance, by FACS analysis. The FACS analysis is carried out in a way that the respective monoclonal antibody is tested for binding to human and non-chimpanzee primate cells, e.g. macaque cells, expressing said human and non-chimpanzee primate CD3 epsilon antigens, respectively. An appropriate assay is shown in the following examples. The above-mentioned subject matter applies mutatis mutandis for the target antigens PSMA, FAPα, endosialin (TEM1), c-MET and IGF-1R: Cross-species specificity of a monoclonal antibody recognizing e.g. human PSMA, to a non-chimpanzee primate PSMA, e.g. macaque PSMA, can be determined, for instance, by FACS analysis. The FACS analysis is carried out in a way that the respective monoclonal antibody is tested for binding to human and non-chimpanzee primate cells, e.g. macaque cells, expressing said human and non-chimpanzee primate PSMA antigens, respectively.

As used herein, CD3 epsilon denotes a molecule expressed as part of the T cell receptor and has the meaning as typically ascribed to it in the prior art. In human, it encompasses in individual or independently combined form all known CD3 subunits, for example CD3 epsilon, CD3 delta, CD3 gamma, CD3 zeta, CD3 alpha and CD3 beta. The non-chimpanzee primate, non-human CD3 antigens as referred to herein are, for example, *Macaca fascicularis* CD3 and Macaca mulatta CD3. In *Macaca fascicularis*, it encompasses CD3 epsilon FN-18 negative and CD3 epsilon FN-18 positive, CD3 gamma and CD3 delta. In *Macaca mulatta*, it encompasses CD3 epsilon, CD3 gamma and CD3 delta. Preferably, said CD3 as used herein is CD3 epsilon.

The human CD3 epsilon is indicated in GenBank Accession No. NM_000733 and comprises SEQ ID NO. 1. The human CD3 gamma is indicated in GenBank Accession NO. NM_000073. The human CD3 delta is indicated in GenBank Accession No. NM_000732.

The CD3 epsilon "FN-18 negative" of *Macaca fascicularis* (i.e. CD3 epsilon not recognized by monoclonal antibody FN-18 due to a polymorphism as set forth above) is indicated in GenBank Accession No. AB073994.

The CD3 epsilon "FN-18 positive" of *Macaca fascicularis* (i.e. CD3 epsilon recognized by monoclonal antibody FN-18) is indicated in GenBank Accession No. AB073993. The CD3 gamma of *Macaca fascicularis* is indicated in GenBank Accession No. AB073992. The CD3 delta of *Macaca fascicularis* is indicated in GenBank Accession No. AB073991.

The nucleic acid sequences and amino acid sequences of the respective CD3 epsilon, gamma and delta homologs of *Macaca mulatta* can be identified and isolated by recombinant techniques described in the art (Sambrook et al. Molecular Cloning: A Laboratory Manual; Cold Spring Harbor Laboratory Press, $3^{rd}$ edition 2001). This applies mutatis mutandis to the CD3 epsilon, gamma and delta homologs of other non-chimpanzee primates as defined herein. The identification of the amino acid sequence of *Callithrix jacchus, Saimiri sciureus* and *Saguinus oedipus* is described in the appended examples. The amino acid sequence of the extracellular domain of the CD3 epsilon of *Callithrix jacchus* is depicted in SEQ ID NO: 3, the one of *Saguinus oedipus* is depicted in SEQ ID NO: 5 and the one of *Saimiri sciureus* is depicted in SEQ ID NO: 7.

In line with the above, the term "epitope" defines an antigenic determinant, which is specifically bound/identified by a binding domain as defined herein. The binding domain may specifically bind to/interact with conformational or continuous epitopes, which are unique for the target structure, e.g. the human and non-chimpanzee primate CD3 epsilon chain. A conformational or discontinuous epitope is characterized for polypeptide antigens by the presence of two or more discrete amino acid residues which are separated in the primary sequence, but come together on the surface of the molecule when the polypeptide folds into the native protein/antigen (Sela, (1969) Science 166, 1365 and Layer, (1990) Cell 61, 553-6). The two or more discrete amino acid residues contributing to the epitope are present on separate sections of one or more polypeptide chain(s). These residues come together on the surface of the molecule when the polypeptide chain(s) fold(s) into a three-dimensional structure to constitute the epitope. In contrast, a continuous or linear epitope consists of two or more discrete amino acid residues, which are present in a single linear segment of a polypeptide chain. Within the present invention, a "context-dependent" CD3 epitope refers to the conformation of said epitope. Such a context-dependent epitope, localized on the epsilon chain of CD3, can only develop its correct conformation if it is embedded within the rest of the epsilon chain and held in the right position by heterodimerization of the epsilon chain with either CD3 gamma or delta chain. In contrast, a context-independent CD3 epitope as provided herein refers to an N-terminal 1-27 amino acid residue polypeptide or a functional fragment thereof of CD3 epsilon. This N-terminal 1-27 amino acid residue polypeptide or a functional fragment thereof maintains its three-dimensional structural integrity and correct conformation when taken out of its native environment in the CD3 complex. The context-independency of the N-terminal 1-27 amino acid residue polypeptide or a functional fragment thereof, which is part of the extracellular domain of CD3 epsilon, represents, thus, an epitope which is completely different to the epitopes of CD3 epsilon described in connection with a method for the preparation of human binding molecules in WO 2004/106380. Said method used solely expressed recombinant CD3 epsilon. The conformation of this solely expressed recombinant CD3 epsilon differed from that adopted in its natural form, that is, the form in which the CD3 epsilon subunit of the TCR/CD3 complex exists as part of a noncovalent complex with either the CD3 delta or the CD3-gamma subunit of the TCR/CD3 complex. When such solely expressed recombinant CD3 epsilon protein is used as an antigen for selection of antibodies from an antibody library, antibodies specific for this antigen are identified from the library although such a library does not contain antibodies with specificity for self-antigens/autoantigens. This is due to the fact that solely expressed recombinant CD3 epsilon protein does not exist in vivo; it is not an autoantigen. Consequently, subpopulations of B cells expressing antibodies specific for this protein have not been depleted in vivo; an antibody library constructed from such B cells would contain genetic material for antibodies specific for solely expressed recombinant CD3 epsilon protein.

However, since the context-independent N-terminal 1-27 amino acid residue polypeptide or a functional fragment thereof is an epitope, which folds in its native form, binding domains in line with the present invention cannot be identified by methods based on the approach described in WO 2004/106380. Therefore, it could be verified in tests that binding molecules as disclosed in WO 2004/106380 are not capable of binding to the N-terminal 1-27 amino acid residues of the CD3 epsilon chain. Hence, conventional anti-CD3 binding molecules or anti-CD3 antibody molecules (e.g. as disclosed in WO 99/54440) bind CD3 epsilon chain at a position which is more C-terminally located than the context-independent N-terminal 1-27 amino acid residue polypeptide or a functional fragment provided herein. Prior art antibody molecules OKT3 and UCHT-1 have also a specificity for the epsilon-subunit of the TCR/CD3 complex between amino acid residues 35 to 85 and, accordingly, the epitope of these antibodies is also more C-terminally located. In addition, UCHT-1 binds to the CD3 epsilon chain in a region between amino acid residues 43 to 77 (Tunnacliffe, Int. Immunol. 1 (1989), 546-50; Kjer-Nielsen, PNAS 101, (2004), 7675-7680; Salmeron, J. Immunol. 147 (1991), 3047-52). Therefore, prior art anti-CD3 molecules do not bind to and are not directed against the herein defined context-independent N-terminal 1-27 amino acid residue epitope (or a functional fragment thereof). In particular, the state of the art fails to provide anti-CD3 molecules which specifically binds to the context-independent N-terminal 1-27 amino acid residue epitope and which are cross-species specific, i.e. bind to human and non-chimpanzee primate CD3 epsilon.

As used herein, the term "humanized", "humanization", "human-like" or grammatically related variants thereof are used interchangeably to refer to a bispecific single chain antibody comprising in at least one of its binding domains at least one complementarity determining region ("CDR") from a non-human antibody or fragment thereof. Humanization approaches are described for example in WO 91/09968 and U.S. Pat. No. 6,407,213. As non-limiting examples, the term encompasses the case in which a variable region of at least one binding domain comprises a single CDR region, for example the third CDR region of the VH(CDRH3), from another non-human animal, for example a rodent, as well as the case in which a or both variable region/s comprise at each of their respective first, second and third CDRs the CDRs from said non-human animal. In the event that all CDRs of a binding domain of the bispecific single chain antibody have been replaced by their corresponding equivalents from, for example, a rodent, one typically speaks of "CDR-grafting", and this term is to be understood as being encompassed by the term "humanized" or grammatically related variants thereof as used herein. The term "humanized" or grammatically related variants thereof also encompasses cases in which, in addition to replacement of one or more CDR regions within a VH and/or VL of the first and/or second binding domain further mutation/s (e.g. substitutions) of at least one single amino acid residue/s within the framework ("FR") regions between the CDRs has/have been effected such that the amino acids at that/those positions correspond/s to the amino acid/s at that/those position/s in the animal from which the CDR regions used for replacement is/are derived. As is known in the art, such individual mutations are often made in the framework regions following CDR-grafting in order to restore the original binding affinity of the non-human antibody used as a CDR-donor for its target molecule. The term "humanized" may further encompass (an) amino acid substitution(s) in the CDR regions from a non-human animal to the amino acid(s) of a corresponding CDR region from a human antibody, in addition to the amino acid substitutions in the framework regions as described above.

As used herein, the term "homolog" or "homology" is to be understood as follows: Homology among proteins and DNA is often concluded on the basis of sequence similarity, especially in bioinformatics. For example, in general, if two or more genes have highly similar DNA sequences, it is likely that they are homologous. But sequence similarity may arise from different ancestors: short sequences may be similar by chance, and sequences may be similar because both were selected to bind to a particular protein, such as a transcription factor. Such sequences are similar but not homologous. Sequence regions that are homologous are also called conserved. This is not to be confused with conservation in amino acid sequences in which the amino acid at a specific position has changed but the physio-chemical properties of the amino acid remain unchanged. Homologous sequences are of two types: orthologous and paralogous. Homologous sequences are orthologous if they were separated by a speciation event: when a species diverges into two separate species, the divergent copies of a single gene in the resulting species are said to be orthologous. Orthologs, or orthologous genes, are genes in different species that are similar to each other because they originated from a common ancestor. The strongest evidence that two similar genes are orthologous is the result of a phylogenetic analysis of the gene lineage. Genes that are found within one Glade are orthologs, descended from a common ancestor. Orthologs often, but not always, have the same function. Orthologous sequences provide useful information in taxonomic classification studies of organisms. The pattern of genetic divergence can be used to trace the relatedness of organisms. Two organisms that are very closely related are likely to display very similar DNA sequences between two orthologs. Conversely, an organism that is further removed evolutionarily from another organism is likely to display a greater divergence in the sequence of the orthologs being studied. Homologous sequences are paralogous if they were separated by a gene duplication event: if a gene in an organism is duplicated to occupy two different positions in the same genome, then the two copies are paralogous. A set of sequences that are paralogous are called paralogs of each other. Paralogs typically have the same or similar function, but sometimes do not: due to lack of the original selective pressure upon one copy of the duplicated gene, this copy is free to mutate and acquire new functions. An example can be found in rodents such as rats and mice. Rodents have a pair of paralogous insulin genes, although it is unclear if any divergence in function has occurred. Paralogous genes often belong to the same species, but this is not necessary: for example, the hemoglobin gene of humans and the myoglobin gene of chimpanzees are paralogs. This is a common problem in bioinformatics: when genomes of different species have been sequenced and homologous genes have been found, one can not immediately conclude that these genes have the same or similar function, as they could be paralogs whose function has diverged.

As used herein, a "non-chimpanzee primate" or "non-chimp primate" or grammatical variants thereof refers to any primate animal (i.e. not human) other than chimpanzee, i.e. other than an animal of belonging to the genus *Pan*, and including the species *Pan paniscus* and *Pan troglodytes*, also known as *Anthropopithecus troglodytes* or *Simia satyrus*. It will be understood, however, that it is possible that the antibodies of the invention can also bind with their first and/or second binding domain to the respective epitopes/fragments etc. of said chimpanzees. The intention is merely to avoid animal tests which are carried out with chimpanzees, if desired. It is thus also envisaged that in another embodiment the antibodies of the present invention also bind with their first and/or second binding domain to the respective epitopes of chimpanzees. A "primate", "primate species", "primates" or grammatical variants thereof denote/s an order of eutherian mammals divided into the two suborders of prosimians and anthropoids and comprising apes, monkeys and lemurs. Specifically, "primates" as used herein comprises the suborder Strepsirrhini (non-tarsier prosimians), including the infraorder Lemuriformes (itself including the superfamilies Chemogaleoidea and Lemuroidea), the infraorder Chiromyiformes (itself including the family Daubentoniidae) and the infraorder Lorisiformes (itself including the families Lorisidae and Galagidae). "Primates" as used herein also comprises the suborder Haplorrhini, including the infraorder Tarsiiformes (itself including the family Tarsiidae), the infraorder Simiiformes (itself including the Platyrrhini, or New-World monkeys, and the Catarrhini, including the Cercopithecidea, or Old-World Monkeys).

The non-chimpanzee primate species may be understood within the meaning of the invention to be a lemur, a tarsier, a gibbon, a marmoset (belonging to New-World Monkeys of the family Cebidae) or an Old-World Monkey (belonging to the superfamily Cercopithecoidea).

As used herein, an "Old-World Monkey" comprises any monkey falling in the superfamily Cercopithecoidea, itself subdivided into the families: the Cercopithecinae, which are mainly African but include the diverse genus of macaques which are Asian and North African; and the Colobinae, which include most of the Asian genera but also the African colobus monkeys.

Specifically, within the subfamily Cercopithecinae, an advantageous non-chimpanzee primate may be from the Tribe Cercopithecini, within the genus *Allenopithecus* (Allen's Swamp Monkey, *Allenopithecus nigroviridis*); within the genus *Miopithecus* (Angolan Talapoin, *Miopithecus talapoin*; Gabon Talapoin, *Miopithecus ogouensis*); within the genus *Erythrocebus* (Patas Monkey, *Erythrocebus patas*); within the genus *Chlorocebus* (Green Monkey, *Chlorocebus sabaceus*; Grivet, *Chlorocebus aethiops*; Bale Mountains Vervet, *Chlorocebus djamdjamensis*; Tantalus Monkey, *Chlorocebus tantalus*; Vervet Monkey, *Chlorocebus pygerythrus*; Malbrouck, *Chlorocebus cynosuros*); or within the genus *Cercopithecus* (Dryas Monkey or Salongo Monkey, *Cercopithecus dryas*; Diana Monkey, *Cercopithecus diana*; Roloway Monkey, *Cercopithecus roloway*; Greater Spot-nosed Monkey, *Cercopithecus nictitans*; Blue Monkey, *Cercopithecus mitis*; Silver Monkey, *Cercopithecus doggetti*; Golden Monkey, *Cercopithecus kandti*; Sykes's Monkey, *Cercopithecus albogularis*; Mona Monkey, *Cercopithecus mona*; Campbell's Mona Monkey, *Cercopithecus campbelli*; Lowe's Mona Monkey, *Cercopithecus lowei*; Crested Mona Monkey, *Cercopithecus pogonias*; Wolfs Mona Monkey, *Cercopithecus wolfi*; Dent's Mona Monkey, *Cercopithecus denti*; Lesser Spot-nosed Monkey, *Cercopithecus petaurista*; White-throated Guenon, *Cercopithecus erythrogaster*; Sclater's Guenon, *Cercopithecus sclateri*; Red-eared Guenon, *Cercopithecus erythrotis*; Moustached Guenon, *Cercopithecus cephus*; Red-tailed Monkey, *Cercopithecus ascanius*; L'Hoest's Monkey, *Cercopithecus lhoesti*; Preuss's Monkey, *Cercopithecus preussi*; Sun-tailed Monkey, *Cercopithecus solatus*; Hamlyn's Monkey or Owl-faced Monkey, *Cercopithecus hamlyni*; De Brazza's Monkey, *Cercopithecus neglectus*).

Alternatively, an advantageous non-chimpanzee primate, also within the subfamily Cercopithecinae but within the Tribe Papionini, may be from within the genus *Macaca* (Barbary Macaque, *Macaca sylvanus*; Lion-tailed Macaque, *Macaca silenus*; Southern Pig-tailed Macaque or Beruk, *Macaca nemestrina*; Northern Pig-tailed Macaque, *Macaca leonina*; Pagai Island Macaque or Bokkoi, *Macaca pagensis*; Siberut Macaque, *Macaca siberu*; Moor Macaque, *Macaca maura*; Booted Macaque, *Macaca ochreata*; Tonkean Macaque, *Macaca tonkeana*; Heck's Macaque, *Macaca hecki*; Gorontalo Macaque, *Macaca nigriscens*; Celebes Crested Macaque or Black "Ape", *Macaca nigra*; Cynomolgus monkey or Crab-eating Macaque or Long-tailed Macaque or Kera, *Macaca fascicularis*; Stump-tailed Macaque or Bear Macaque, *Macaca arctoides*; Rhesus Macaque, *Macaca mulatta*; Formosan Rock Macaque, *Macaca cyclopis*; Japanese Macaque, *Macaca fuscata*; Toque Macaque, *Macaca sinica*; Bonnet Macaque, *Macaca radiata*; Barbary Macaque, *Macaca sylvanmus*; Assam Macaque, *Macaca assamensis*; Tibetan Macaque or Milne-Edwards' Macaque, *Macaca thibetana*; Arunachal Macaque or Munzala, *Macaca munzala*); within the genus *Lophocebus* (Gray-cheeked Mangabey, *Lophocebus albigena; Lophocebus albigena albigena; Lophocebus albigena osmani; Lophocebus albigena johnstoni*; Black Crested Mangabey, *Lophocebus aterrimus*; Opdenbosch's Mangabey, *Lophocebus opdenboschi*; Highland Mangabey, *Lophocebus kipunji*); within the genus *Papio* (Hamadryas Baboon, *Papio hamadryas*; Guinea Baboon, *Papio papio*; Olive Baboon, *Papio anubis*; Yellow Baboon, *Papio cynocephalus*; Chacma Baboon, *Papio ursi-*

*nus*); within the genus *Theropithecus* (Gelada, *Theropithecus gelada*); within the genus *Cercocebus* (Sooty Mangabey, *Cercocebus atys; Cercocebus atys atys; Cercocebus atys lunulatus*; Collared Mangabey, *Cercocebus torquatus*; Agile Mangabey, *Cercocebus agilis*; Golden-bellied Mangabey, *Cercocebus chrysogaster*; Tana River Mangabey, *Cercocebus galeritus*; Sanje Mangabey, *Cercocebus sanjei*); or within the genus *Mandrillus* (Mandrill, *Mandrillus sphinx*; Drill, *Mandrillus leucophaeus*).

Most preferred is *Macaca fascicularis* (also known as Cynomolgus monkey and, therefore, in the Examples named "Cynomolgus") and *Macaca mulatta* (rhesus monkey, named "rhesus").

Within the subfamily Colobinae, an advantageous non-chimpanzee primate may be from the African group, within the genus *Colobus* (Black Colobus, *Colobus satanas*; Angola Colobus, *Colobus angolensis*; King Colobus, *Colobus polykomos*; Ursine Colobus, *Colobus vellerosus*; Mantled Guereza, *Colobus guereza*); within the genus *Piliocolobus* (Western Red Colobus, *Piliocolobus badius; Piliocolobus badius badius; Piliocolobus badius temminckii; Piliocolobus badius waldronae*; Pennant's Colobus, *Piliocolobus pennantii; Piliocolobus pennantii pennantii; Piliocolobus pennantii epieni; Piliocolobus pennantii bouvieri*; Preuss's Red Colobus, *Piliocolobus preussi*; Thollon's Red Colobus, *Piliocolobus tholloni*; Central African Red Colobus, *Piliocolobus foai; Piliocolobus foai foai; Piliocolobus foai ellioti; Piliocolobus foai oustaleti; Piliocolobus foai semlikiensis; Piliocolobus foai parmentierorum*; Ugandan Red Colobus, *Piliocolobus tephrosceles*; Uzyngwa Red Colobus, *Piliocolobus gordonorum*; Zanzibar Red Colobus, *Piliocolobus kirkii*; Tana River Red Colobus, *Piliocolobus rufomitratus*); or within the genus *Procolobus* (Olive Colobus, *Procolobus verus*). Within the subfamily Colobinae, an advantageous non-chimpanzee primate may alternatively be from the Langur (leaf monkey) group, within the genus *Semnopithecus* (Nepal Gray Langur, *Semnopithecus schistaceus*; Kashmir Gray Langur, *Semnopithecus ajax*; Tarai Gray Langur, *Semnopithecus hector*; Northern Plains Gray Langur, *Semnopithecus entellus*; Black-footed Gray Langur, *Semnopithecus hypoleucos*; Southern Plains Gray Langur, *Semnopithecus dussumieri*; Tufted Gray Langur, *Semnopithecus priam*); within the *T. vetulus* group or the genus *Trachypithecus* (Purple-faced Langur, *Trachypithecus vetulus*; Nilgiri Langur, *Trachypithecus johnii*); within the *T. cristatus* group of the genus *Trachypithecus* (Javan Lutung, *Trachypithecus auratus*; Silvery Leaf Monkey or Silvery Lutung, *Trachypithecus cristatus*; Indochinese Lutung, *Trachypithecus germaini*; Tenasserim Lutung, *Trachypithecus barbei*); within the *T. obscurus* group of the genus *Trachypithecus* (Dusky Leaf Monkey or Spectacled Leaf Monkey, *Trachypithecus obscurus*; Phayre's Leaf Monkey, *Trachypithecus phayrei*); within the *T. pileatus* group of the genus *Trachypithecus* (Capped Langur, *Trachypithecus pileatus*; Shortridge's Langur, *Trachypithecus shortridgei*; Gee's Golden Langur, *Trachypithecus geei*); within the *T. francoisi* group of the genus *Trachypithecus* (Francois' Langur, *Trachypithecus francoisi*; Hatinh Langur, *Trachypithecus hatinhensis*; White-headed Langur, *Trachypithecus poliocephalus*; Laotian Langur, *Trachypithecus laotum*; Delacour's Langur, *Trachypithecus delacouri*; Indochinese Black Langur, *Trachypithecus ebenus*); or within the genus *Presbytis* (Sumatran Surili, *Presbytis melalophos*; Banded Surili, *Presbytis femoralis*; Sarawak Surili, *Presbytis chrysomelas*; White-thighed Surili, *Presbytis siamensis*; White-fronted Surili, *Presbytis frontata*; Javan Surili, *Presbytis comata*; Thomas's Langur, *Presbytis thomasi*; Hose's Langur, *Presbytis hosei*; Maroon Leaf Monkey, *Presbytis rubicunda*; Mentawai Langur or Joja, *Presbytis potenziani*; Natuna Island Surili, *Presbytis natunae*).

Within the subfamily Colobinae, an advantageous non-chimpanzee primate may alternatively be from the Odd-Nosed group, within the genus *Pygathrix* (Red-shanked Douc, *Pygathrix nemaeus*; Black-shanked Douc, *Pygathrix nigripes*; Gray-shanked Douc, *Pygathrix cinerea*); within the genus *Rhinopithecus* (Golden Snub-nosed Monkey, *Rhinopithecus roxellana*; Black Snub-nosed Monkey, *Rhinopithecus bieti*; Gray Snub-nosed Monkey, *Rhinopithecus brelichi*; Tonkin Snub-nosed Langur, *Rhinopithecus avunculus*); within the genus *Nasalis* (Proboscis Monkey, *Nasalis larvatus*); or within the genus *Simias* (Pig-tailed Langur, *Simias concolor*).

As used herein, the term "marmoset" denotes any New-World Monkeys of the genus *Callithrix*, for example belonging to the Atlantic marmosets of subgenus *Callithrix* (sic!) (Common Marmoset, *Callithrix (Callithrix) jacchus*; Black-tufted Marmoset, *Callithrix (Callithrix) penicillata*; Wied's Marmoset, *Callithrix (Callithrix) kuhlii*; White-headed Marmoset, *Callithrix (Callithrix) geoffroyi*; Buffy-headed Marmoset, *Callithrix (Callithrix) flaviceps*; Buffy-tufted Marmoset, *Callithrix (Callithrix) aurita*); belonging to the Amazonian marmosets of subgenus *Mico* (Rio Acari Marmoset, *Callithrix (Mico) acariensis*; Manicore Marmoset, *Callithrix (Mico) manicorensis*; Silvery Marmoset, *Callithrix (Mico) argentata*; White Marmoset, *Callithrix (Mico) leucippe*; Emilia's Marmoset, *Callithrix (Mico) emiliae*; Black-headed Marmoset, *Callithrix (Mico) nigriceps*; Marca's Marmoset, *Callithrix (Mico)marcai*; Black-tailed Marmoset, *Callithrix (Mico) melanura*; Santarem Marmoset, *Callithrix (Mico) humeralifera*; Maues Marmoset, *Callithrix (Mico) mauesi*; Gold-and-white Marmoset, *Callithrix (Mico) chrysoleuca*; Hershkovitz's Marmoset, *Callithrix (Mico) intermedia*; Satere Marmoset, *Callithrix (Mico) saterei*); Roosmalens' Dwarf Marmoset belonging to the subgenus *Callibella* (*Callithrix (Callibella) humilis*); or the Pygmy Marmoset belonging to the subgenus *Cebuella* (*Callithrix (Cebuella) pygmaea*).

Other genera of the New-World Monkeys comprise tamarins of the genus *Saguinus* (comprising the *S. oedipus*-group, the *S. midas* group, the *S. nigricollis* group, the *S. mystax* group, the *S. bicolor* group and the *S. inustus* group) and squirrel monkeys of the genus *Samiri* (e.g. *Saimiri sciureus, Saimiri oerstedii, Saimiri ustus, Saimiri boliviensis, Saimiri vanzolini*).

Advantageously, the present invention provides also target antigen×CD3 bispecific single chain antibodies comprising a second binding domain which binds both to the human target antigen and to the macaque target antigen homolog, i.e. the homolog of a non-chimpanzee primate. In a preferred embodiment, the bispecific single chain antibody thus comprises a second binding domain exhibiting cross-species specificity to the human and a non-chimpanzee primate target antigen. In this case, the identical bispecific single chain antibody molecule can be used both for preclinical evaluation of safety, activity and/or pharmacokinetic profile of these binding domains in primates and as drug in humans. Put in other words, the same molecule can be used in preclinical animal studies as well as in clinical studies in humans. This leads to highly comparable results and a much-increased predictive power of the animal studies compared to species-specific surrogate molecules. Since both the CD3 and the target antigen binding domain of the target antigen×CD3 bispecific single chain antibody of the invention are cross-species specific, i.e. reactive with the human and non-chimpanzee primates' antigens, it can be used both for preclinical evaluation of safety, activity and/or pharmacokinetic profile of these binding domains in primates and—in the identical form—as drug in humans. It will be understood that in a preferred embodiment, the cross-species specificity of the first and second binding domain of the antibodies of the invention is identical.

It has been found in the present invention that it is possible to generate a, preferably human, target antigen×CD3 bispecific single chain antibody wherein the identical molecule can be used in preclinical animal testing, as well as clinical studies and even in therapy in human. This is due to the unexpected identification of the, preferably human, target antigen×CD3 bispecific single chain antibody, which, in addition to binding to human CD3 epsilon and target antigen, respectively, (and due to genetic similarity likely to the chimpanzee counterpart), also binds to the homologs of said antigens of non-chimpanzee primates, including New-World Monkeys and Old-World Monkeys. The preferably human, target antigen×CD3 bispecific single chain antibody of the invention can be used as therapeutic agent against various diseases, including, but not limited, to cancer. In view of the above, the need to construct a surrogate target antigen×CD3 bispecific single chain antibody for testing in a phylogenetic distant (from humans) species disappears. As a result, the identical molecule can be used in animal preclinical testing as is intended to be administered to humans in clinical testing as well as following market approval and therapeutic drug administration. The ability to use the same molecule for preclinical animal testing as in later administration to humans virtually eliminates, or at least greatly reduces, the danger that the data obtained in preclinical animal testing have limited applicability to the human case. In short, obtaining preclinical safety data in animals using the same molecule as will actually be administered to humans does much to ensure the applicability of the data to a human-relevant scenario. In contrast, in conventional approaches using surrogate molecules, said surrogate molecules have to be molecularly adapted to the animal test system used for preclinical safety assessment. Thus, the molecule to be used in human therapy in fact differs in sequence and also likely in structure from the surrogate molecule used in preclinical testing in pharmacokinetic parameters and/or biological activity, with the consequence that data obtained in preclinical animal testing have limited applicability/transferability to the human case. The use of surrogate molecules requires the construction, production, purification and characterization of a completely new construct. This leads to additional development costs and time necessary to obtain that molecule. In sum, surrogates have to be developed separately in addition to the actual drug to be used in human therapy, so that two lines of development for two molecules have to be carried out. Therefore, a major advantage of the, preferably human, target antigen×CD3 bispecific single chain antibody of the invention exhibiting cross-species specificity described herein is that the identical molecule can be used for therapeutic agents in humans and in preclinical animal testing.

It is preferred that at least one of said first or second binding domains of the bispecific single chain antibody of the invention is CDR-grafted, humanized or human, as set forth in more detail below. Preferably, both the first and second binding domains of the bispecific single chain antibody of the invention are CDR-grafted, humanized or human. For the preferably human, target antigen×CD3 bispecific single chain antibody of the invention, the generation of an immune reaction against said binding molecule is excluded to the maximum possible extent upon administration of the molecule to human patients.

Another major advantage of the, preferably human, target antigen×CD3 bispecific single chain antibody of the invention is its applicability for preclinical testing in various primates. The behavior of a drug candidate in animals should ideally be indicative of the expected behavior of this drug candidate upon administration to humans. As a result, the data obtained from such preclinical testing should therefore generally have a highly predictive power for the human case. However, as learned from the tragic outcome of the recent Phase I clinical trial on TGN1412 (a CD28 monoclonal antibody), a drug candidate may act differently in a primate species than in humans: Whereas in preclinical testing of said antibody no or only limited adverse effects have been observed in animal studies performed with cynomolgus monkeys, six human patients developed multiple organ failure upon administration of said antibody (Lancet 368 (2006), 2206-7). The results of these dramatic, non-desired negative events suggest that it may not be sufficient to limit preclinical testing to only one (non-chimpanzee primate) species. The fact that the target antigen×CD3 bispecific single chain antibody of the invention binds to a series of New-World and Old-World Monkeys may help to overcome the problems faced in the case mentioned above. Accordingly, the present invention provides means and methods for minimizing species differences in effects when drugs for human therapy are being developed and tested.

With the, preferably human, cross-species specific target antigen×CD3 bispecific single chain antibody of the invention it is also no longer necessary to adapt the test animal to the drug candidate intended for administration to humans, such as e.g. the creation of transgenic animals. The, preferably human, target antigen×CD3 bispecific single chain antibody of the invention exhibiting cross-species specificity according to the uses and the methods of invention can be directly used for preclinical testing in non-chimpanzee primates, without any genetic manipulation of the animals. As well known to those skilled in the art, approaches in which the test animal is adapted to the drug candidate always bear the risk that the results obtained in the preclinical safety testing are less representative and predictive for humans due to the modification of the animal. For example, in transgenic animals, the proteins encoded by the transgenes are often highly over-expressed. Thus, data obtained for the biological activity of an antibody against this protein antigen may be limited in their predictive value for humans in which the protein is expressed at much lower, more physiological levels.

A further advantage of the uses of the preferably human target antigen×CD3 bispecific single chain antibody of the invention exhibiting cross-species specificity is the fact that chimpanzees as an endangered species are avoided for animal testing. Chimpanzees are the closest relatives to humans and were recently grouped into the family of hominids based on the genome sequencing data (Wildman et al., PNAS 100 (2003), 7181). Therefore, data obtained with chimpanzee is generally considered to be highly predictive for humans. However, due to their status as endangered species, the number of chimpanzees, which can be used for medical experiments, is highly restricted. As stated above, maintenance of chimpanzees for animal testing is therefore both costly and ethically problematic. The uses of the, preferably human, target antigen×CD3 bispecific single chain antibody of the invention avoid both ethical objections and financial burden during preclinical testing without prejudicing the quality, i.e. applicability, of the animal testing data obtained. In light of this, the uses of the, preferably human, target antigen×CD3 bispecific single chain antibody of the invention provide for a reasonable alternative for studies in chimpanzees.

A still further advantage of the, preferably human, target antigen×CD3 bispecific single chain antibody of the invention is the ability of extracting multiple blood samples when using it as part of animal preclinical testing, for example in the course of pharmacokinetic animal studies. Multiple blood extractions can be much more readily obtained with a non-chimpanzee primate than with lower animals, e.g. a mouse. The extraction of multiple blood samples allows continuous testing of blood parameters for the determination of the biological effects induced by the, preferably human, target antigen×CD3 bispecific single chain antibody of the invention. Furthermore, the extraction of multiple blood samples enables the researcher to evaluate the pharmacokinetic profile of the, preferably human, target antigen×CD3 bispecific single chain antibody of the invention as defined herein. In addition, potential side effects, which may be induced by said, preferably human, target antigen×CD3 bispecific single chain antibody of the invention reflected in blood parameters can be measured in different blood samples extracted during the course of the administration of said antibody. This allows the determination of the potential toxicity profile of the, preferably human, target antigen×CD3 bispecific single chain antibody of the invention as defined herein.

The advantages of the, preferably human, target antigen×CD3 bispecific single chain antibody of the invention as defined herein exhibiting cross-species specificity may be briefly summarized as follows:

First, the, preferably human, target antigen×CD3 bispecific single chain antibody of the invention as defined herein used in preclinical testing is the same as the one used in human therapy. Thus, it is no longer necessary to develop two independent molecules, which may differ in their pharmacokinetic properties and biological activity. This is highly advantageous in that e.g. the pharmacokinetic results are more directly transferable and applicable to the human setting than e.g. in conventional surrogate approaches.

Second, the uses of the, preferably human, target antigen×CD3 bispecific single chain antibody of the invention as defined herein for the preparation of therapeutics in human is less cost- and labor-intensive than surrogate approaches.

Third, the, preferably human, target antigen×CD3 bispecific single chain antibody of the invention as defined herein can be used for preclinical testing not only in one primate species, but in a series of different primate species, thereby limiting the risk of potential species differences between primates and human.

Fourth, chimpanzee as an endangered species for animal testing can be avoided if desired.

Fifth, multiple blood samples can be extracted for extensive pharmacokinetic studies.

Sixth, due to the human origin of the, preferably human, binding molecules according to a preferred embodiment of the invention, the generation of an immune reaction against said binding molecules is minimalized when administered to human patients. Induction of an immune response with antibodies specific for a drug candidate derived from a non-human species as e.g. a mouse leading to the development of human-anti-mouse antibodies (HAMAs) against therapeutic molecules of murine origin is excluded.

Last but not least, the therapeutic use of the target antigen×CD3 bispecific single chain antibody of the invention provides a novel and inventive therapeutic approach for cancer, preferably solid tumors, more preferably carcinomas and prostate cancer. As shown in the following examples, the target antigen×CD3 bispecific single chain antibody of the invention provides an advantageous tool in order to kill target antigen-expressing human target cells, e.g. cancer cells.

Moreover, the cytotoxic activity of the target antigen×CD3 bispecific single chain antibody of the invention is higher than the activity of antibodies described in the art for the exemplified targets.

It is further preferred for the method of the invention that the first binding domain capable of binding to an epitope of human and non-chimpanzee primate CD3ε chain comprises a VL region comprising CDR-L1, CDR-L2 and CDR-L3 selected from:
(a) CDR-L1 as depicted in SEQ ID NO. 27, CDR-L2 as depicted in SEQ ID NO. 28 and CDR-L3 as depicted in SEQ ID NO. 29;
(b) CDR-L1 as depicted in SEQ ID NO. 117, CDR-L2 as depicted in SEQ ID NO. 118 and CDR-L3 as depicted in SEQ ID NO. 119; and
(c) CDR-L1 as depicted in SEQ ID NO. 153, CDR-L2 as depicted in SEQ ID NO. 154 and CDR-L3 as depicted in SEQ ID NO. 155.

More preferably, the first binding domain capable of binding to an epitope of human and non-chimpanzee primate CD3ε chain comprises a VL region selected from the group consisting of a VL region as depicted in SEQ ID NO. 35, 39, 125, 129, 161 or 165.

It is alternatively preferred for the method of the invention that the first binding domain capable of binding to an epitope of human and non-chimpanzee primate CD3ε chain comprises a VH region comprising CDR-H1, CDR-H2 and CDR-H3 selected from:
(a) CDR-H1 as depicted in SEQ ID NO. 12, CDR-H2 as depicted in SEQ ID NO. 13 and CDR-H3 as depicted in SEQ ID NO. 14;
(b) CDR-H1 as depicted in SEQ ID NO. 30, CDR-H2 as depicted in SEQ ID NO. 31 and CDR-H3 as depicted in SEQ ID NO. 32;
(c) CDR-H1 as depicted in SEQ ID NO. 48, CDR-H2 as depicted in SEQ ID NO. 49 and CDR-H3 as depicted in SEQ ID NO. 50;
(d) CDR-H1 as depicted in SEQ ID NO. 66, CDR-H2 as depicted in SEQ ID NO. 67 and CDR-H3 as depicted in SEQ ID NO. 68;
(e) CDR-H1 as depicted in SEQ ID NO. 84, CDR-H2 as depicted in SEQ ID NO. 85 and CDR-H3 as depicted in SEQ ID NO. 86;
(f) CDR-H1 as depicted in SEQ ID NO. 102, CDR-H2 as depicted in SEQ ID NO. 103 and CDR-H3 as depicted in SEQ ID NO. 104;
(g) CDR-H1 as depicted in SEQ ID NO. 120, CDR-H2 as depicted in SEQ ID NO. 121 and CDR-H3 as depicted in SEQ ID NO. 122;
(h) CDR-H1 as depicted in SEQ ID NO. 138, CDR-H2 as depicted in SEQ ID NO. 139 and CDR-H3 as depicted in SEQ ID NO. 140;
(i) CDR-H1 as depicted in SEQ ID NO. 156, CDR-H2 as depicted in SEQ ID NO. 157 and CDR-H3 as depicted in SEQ ID NO. 158; and
(j) CDR-H1 as depicted in SEQ ID NO. 174, CDR-H2 as depicted in SEQ ID NO. 175 and CDR-H3 as depicted in SEQ ID NO. 176.

More preferably, the binding domain capable of binding to an epitope of human and non-chimpanzee primate CD3ε chain comprises a VH region selected from the group consisting of a VH region as depicted in SEQ ID NO. 15, 19, 33, 37, 51, 55, 69, 73, 87, 91, 105, 109, 123, 127, 141, 145, 159, 163, 177 or 181.

It is preferred for the method of the invention that the first binding domain capable of binding to an epitope of human and non-chimpanzee primate CD3ε chain comprises a VL region and a VH region selected from the group consisting of:
(a) a VL region as depicted in SEQ ID NO. 17 or 21 and a VH region as depicted in SEQ ID NO. 15 or 19;
(b) a VL region as depicted in SEQ ID NO. 35 or 39 and a VH region as depicted in SEQ ID NO. 33 or 37;
(c) a VL region as depicted in SEQ ID NO. 53 or 57 and a VH region as depicted in SEQ ID NO. 51 or 55;
(d) a VL region as depicted in SEQ ID NO. 71 or 75 and a VH region as depicted in SEQ ID NO. 69 or 73;
(e) a VL region as depicted in SEQ ID NO. 89 or 93 and a VH region as depicted in SEQ ID NO. 87 or 91;
(f) a VL region as depicted in SEQ ID NO. 107 or 111 and a VH region as depicted in SEQ ID NO. 105 or 109;
(g) a VL region as depicted in SEQ ID NO. 125 or 129 and a VH region as depicted in SEQ ID NO. 123 or 127;
(h) a VL region as depicted in SEQ ID NO. 143 or 147 and a VH region as depicted in SEQ ID NO. 141 or 145;
(i) a VL region as depicted in SEQ ID NO. 161 or 165 and a VH region as depicted in SEQ ID NO. 159 or 163; and
(j) a VL region as depicted in SEQ ID NO. 179 or 183 and a VH region as depicted in SEQ ID NO. 177 or 181.

More preferably, the first binding domain capable of binding to an epitope of human and non-chimpanzee primate CD3ε chain comprises an amino acid sequence selected from the group consisting of SEQ ID NOs: 23, 25, 41, 43, 59, 61, 77, 79, 95, 97, 113, 115, 131, 133, 149, 151, 167, 169, 185 or 187.

As already discussed herein above, it is also preferred for the method of the invention that also the second binding domain binds to epitopes/binding sites in the extracellular domain of a high molecular weight antigen of human and non-chimpanzee primate.

In a preferred embodiment of the method of the invention the second binding domain binds to epitopes/binding sites in the extracellular domain of c-MET. This target antigen and its expression characteristics have been described herein above. The MET tyrosine kinase receptor with an extracellular region of 908 aa with the following sequential arrangement of independently folded extracellular domains from membrane-proximal to membrane-distal: Four Ig domains of together 362 aa (residues 563-924), a cystein-rich domain of 42 aa (residues 520-561), the beta-chain of a sema domain of 212 aa (residues 308-519) and the alpha-chain of the sema domain of 282 aa (residues 25-307). Accordingly, it is preferred for the method of the invention, that the second binging domain binds to epitopes/binding sites in the four Ig domains (SEQ ID NO: 436), a cystein-rich domain (SEQ ID NO: 437), or the beta-chain of a sema domain (SEQ ID NO: 438) of the extracellular domain of c-MET, which are all below the 640 aa-threshold.

In an alternatively preferred embodiment of the method of the invention the second binding domain binds to epitopes/binding sites in the extracellular domain of endosialin (TEM1). This target antigen and its expression characteristics have been described herein above. For endosialin a extracellular domain consisting of 665 aa and the following sequential arrangement of independently folded extracellular domains from membrane-proximal to membrane-distal is described in the art: a mucin domain of 326 aa (residues 360-685), three EGF-like domains of together 116 aa (residues 235-350), a Sushi/SCR/CCP domain of 55 aa (residues 176-230) and a C-type lectin domain of 129 aa (residues 29-157). Accordingly, it is preferred for the method of the invention that the second binging domain binds to epitopes/binding sites in the mucin domain (SEQ ID NO: 440), the three EGF-like domains (SEQ ID NO: 441), or the Sushi/SCR/CCP domain (SEQ ID NO: 442) of the extracellular domain of TEM1.

According to a further alternatively preferred embodiment of the method of the invention the second binding domain binds to epitopes/binding sites in the extracellular domain of IGF-1R. This target antigen and its expression characteristics have been described herein above. For endosialin a extracellular domain consisting of 905 aa and the following sequential arrangement of independently folded extracellular domains from membrane-proximal to membrane-distal is described in the art: three fibronectin type III domains of together 447 aa (residues 460-906), an L2 domain of 160 aa (residues 300-459), a cystein-rich domain of 149 aa (residues 151-299) and an L1 domain of 150 aa (residues 1-150). Accordingly, it is preferred for the method of the invention that the second binging domain binds to epitopes/binding sites in the three fibronectin type III domains (SEQ ID NO: 444), and the L2 domain (SEQ ID NO: 445) of the extracellular domain of IGF-1R.

An alternative embodiment of the invention relates to a bispecific single chain antibody comprising a first domain binding domain capable of binding to CD3 epsilon (CD3ε) of human and non-chimpanzee primate and a second domain binding domain capable of binding to the extracellular domain of the mutated human PSMA having an amino acid sequence as depicted in SEQ ID NO: 447 but not to the extracellular domain of the rodent PSMA. In other words, the bispecific antibody of the invention specifically binds to membrane proximal epitopes, i.e. epitopes formed only by amino acid resides of the extracellular domain of PSMA, the alpha C-atom of which has a distance of less than 60 Å from the reference C-atom (the alpha C-atom of the $13^{th}$ aa as counted from the junction of transmembrane and extracellular region). The specific superior characteristics of these PSMA×CD3 bispecific single chain antibodies have been described herein above. Moreover, corresponding antibodies are exemplified and characterized in the appended examples.

It is preferred for the bispecific ingle chain antibody comprising a first domain binding domain capable of binding to CD3 epsilon (CD3ε) and a second domain binding domain capable of binding to the extracellular domain of the mutated human PSMA having an amino acid sequence as depicted in SEQ ID NO: 447 but not to the extracellular domain of the rodent PSMA that the first domain capable of binding to an epitope of human and non-chimpanzee primate CD3ε chain comprises an amino acid sequence selected from the group consisting of SEQ ID NOs: 23, 25, 41, 43, 59, 61, 77, 79, 95, 97, 113, 115, 131, 133, 149, 151, 167, 169, 185 or 187. It is preferred for the bispecific single chain antibodies that the second domain comprises a VL region comprising CDR-L1, CDR-L2 and CDR-L3 selected from:
(a) CDR-L1 as depicted in SEQ ID NO. 269, CDR-L2 as depicted in SEQ ID NO: 270 and CDR-L3 as depicted in SEQ ID NO. 271;
(b) CDR-L1 as depicted in SEQ ID NO. 283, CDR-L2 as depicted in SEQ ID NO: 284 and CDR-L3 as depicted in SEQ ID NO. 285;
(c) CDR-L1 as depicted in SEQ ID NO. 297, CDR-L2 as depicted in SEQ ID NO: 298 and CDR-L3 as depicted in SEQ ID NO. 299;
(d) CDR-L1 as depicted in SEQ ID NO. 311, CDR-L2 as depicted in SEQ ID NO: 312 and CDR-L3 as depicted in SEQ ID NO. 313;
(e) CDR-L1 as depicted in SEQ ID NO. 325, CDR-L2 as depicted in SEQ ID NO. 326 and CDR-L3 as depicted in SEQ ID NO. 327;

(f) CDR-L1 as depicted in SEQ ID NO. 255, CDR-L2 as depicted in SEQ ID NO. 256 and CDR-L3 as depicted in SEQ ID NO. 257; and
(g) CDR-L1 as depicted in SEQ ID NO. 481, CDR-L2 as depicted in SEQ ID NO. 482 and CDR-L3 as depicted in SEQ ID NO. 483.

It is also preferred for the bispecific single chain antibodies of the invention that the second domain comprises a VH region comprising CDR-H1, CDR-H2 and CDR-H3 selected from:
(a) CDR-H1 as depicted in SEQ ID NO. 274, CDR-H2 as depicted in SEQ ID NO: 275 and CDR-H3 as depicted in SEQ ID NO. 276;
(b) CDR-H1 as depicted in SEQ ID NO. 288, CDR-H2 as depicted in SEQ ID NO: 289 and CDR-H3 as depicted in SEQ ID NO. 290;
(c) CDR-H1 as depicted in SEQ ID NO. 302, CDR-H2 as depicted in SEQ ID NO: 303 and CDR-H3 as depicted in SEQ ID NO. 304;
(d) CDR-H1 as depicted in SEQ ID NO. 316, CDR-H2 as depicted in SEQ ID NO: 317 and CDR-H3 as depicted in SEQ ID NO. 318;
(e) CDR-H1 as depicted in SEQ ID NO. 330, CDR-H2 as depicted in SEQ ID NO: 331 and CDR-H3 as depicted in SEQ ID NO. 332;
(f) CDR-H1 as depicted in SEQ ID NO. 260, CDR-H2 as depicted in SEQ ID NO: 261 and CDR-H3 as depicted in SEQ ID NO. 262; and
(g) CDR-H1 as depicted in SEQ ID NO. 476, CDR-H2 as depicted in SEQ ID NO: 477 and CDR-H3 as depicted in SEQ ID NO. 478.

In a further preferred embodiment of a bispecific single chain antibody of the invention the second domain comprises a VL region and a VH region selected from the group consisting of:
(a) a VL region as depicted in SEQ ID NO. 268 and a VH region as depicted in SEQ ID NO. 273;
(b) a VL region as depicted in SEQ ID NO. 282 and a VH region as depicted in SEQ ID NO. 287;
(c) a VL region as depicted in SEQ ID NO. 296 and a VH region as depicted in SEQ ID NO. 301;
(d) a VL region as depicted in SEQ ID NO. 310 and a VH region as depicted in SEQ ID NO. 315;
(e) a VL region as depicted in SEQ ID NO. 324 and a VH region as depicted in SEQ ID NO. 329;
(f) a VL region as depicted in SEQ ID NO. 254 and a VH region as depicted in SEQ ID NO. 259; and
(g) a VL region as depicted in SEQ ID NO. 480 and a VH region as depicted in SEQ ID NO. 475.

More preferably, the second domain comprises an amino acid sequence selected from the group consisting of SEQ ID NOs: 278, 292, 306, 320, 334, 485 or 264.

It is preferred for the bispecific single chain antibody comprising a first domain binding domain capable of binding to CD3 epsilon (CD3ε) of human and non-chimpanzee primate and a second domain binding domain capable of binding to the extracellular domain of the mutated human PSMA chimera that the first domain capable of binding to an epitope of human and non-chimpanzee primate CD3ε chain comprises an amino acid sequence selected from the group consisting of SEQ ID NOs: 23, 25, 41, 43, 59, 61, 77, 79, 95, 97, 113, 115, 131, 133, 149, 151, 167, 169, 185 or 187.

A particularly preferred embodiment of the invention concerns an above characterized polypeptide, wherein the bispecific single chain antibody molecule comprises a sequence selected from:

(a) an amino acid sequence as depicted in any of SEQ ID NOs. 280, 294, 308, 322, 336, 266 or 487;
(b) an amino acid sequence encoded by a nucleic acid sequence as depicted in any of SEQ ID NOs: 281, 295, 309, 267, 323, 337 or 488; and
(c) an amino acid sequence at least 90% identical, more preferred at least 95 identical, most preferred at least 96% identical to the amino acid sequence of (a) or (b).

The invention relates to a bispecific single chain antibody molecule comprising an amino acid sequence as depicted in any of SEQ ID NOs: 280, 294, 266, 308, 322, 336 or 487, as well as to an amino acid sequences at least 85% identical, preferably 90%, more preferred at least 95% identical, most preferred at least 96, 97, 98, or 99% identical to the amino acid sequence of SEQ ID NOs: 280, 294, 266, 308, 322, 336 or 487. The invention relates also to the corresponding nucleic acid sequences as depicted in any of SEQ ID NOs: 281, 295, 267, 309, 323, 337 or 488, as well as to nucleic acid sequences at least 85% identical, preferably 90%, more preferred at least 95% identical, most preferred at least 96, 97, 98, or 99% identical to the nucleic acid sequences shown in SEQ ID NOs: 281, 295, 267, 309, 323, 337 or 488. Preferred domain arrangements in the PSMA×CD3 bispecific single chain antibody constructs of the invention are shown in the following examples.

In a preferred embodiment of the invention, the bispecific single chain antibodies are cross-species specific for CD3 epsilon and for the human and non-chimpanzee primate cell surface antigen PSMA, recognized by their second binding domain.

In an alternative embodiment the invention provides a bispecific single chain antibody comprising a first domain binding domain capable of binding to CD3 epsilon (CD3ε) of human and non-chimpanzee primate and a second domain binding domain capable of binding to the extracellular domain of the mutated human FAPα chimera having an amino acid sequence as depicted in SEQ ID NO: 448 but not to the extracellular domain of the rodent FAPα. In other words, the bispecific antibody of the invention specifically binds to membrane proximal epitopes, i.e. epitopes formed only by amino acid resides of the extracellular domain of FAPα, the alpha C-atom of which has a distance of less than 60 Å from the reference C-atom (the alpha C-atom of the $13^{th}$ aa as counted from the junction of transmembrane and extracellular region).

According to a preferred embodiment of the invention an above characterized bispecific single chain antibody molecule comprises a group of the following sequences as CDR H1, CDR H2, CDR H3, CDR L1, CDR L2 and CDR L3 in the second binding domain selected from:
CDR H1-3 of SEQ ID NO: 1137-1139 and CDR L1-3 of SEQ ID NO: 1132-1134.

The sequences of the corresponding VL- and VH-regions of the second binding domain of the bispecific single chain antibody molecule of the invention as well as of the respective scFvs are shown in the sequence listing.

According to a preferred embodiment of the invention an above characterized bispecific single chain antibody molecule comprises a group of the following sequences as CDR H1, CDR H2, CDR H3, CDR L1, CDR L2 and CDR L3 in the second binding domain selected from the group consisting of:
a) CDR H1-3 of SEQ ID NO: 808-810 and CDR L1-3 of SEQ ID NO: 813-815;
b) CDR H1-3 of SEQ ID NO: 794-796 and CDR L1-3 of SEQ ID NO: 799-801;
c) CDR H1-3 of SEQ ID NO: 738-740 and CDR L1-3 of SEQ ID NO: 743-745;

d) CDR H1-3 of SEQ ID NO: 752-754 and CDR L1-3 of SEQ ID NO: 757-759;
e) CDR H1-3 of SEQ ID NO: 822-824 and CDR L1-3 of SEQ ID NO: 827-829;
f) CDR H1-3 of SEQ ID NO: 766-768 and CDR L1-3 of SEQ ID NO: 771-773; and
g) CDR H1-3 of SEQ ID NO: 780-782 and CDR L1-3 of SEQ ID NO: 785-787.

In the bispecific single chain antibody molecule of the invention the binding domains are arranged in the order VL-VH-VH-VL, VL-VH-VL-VH, VH-VL-VH-VL or VH-VL-VL-VH, as exemplified in the appended examples. Preferably, the binding domains are arranged in the order VH FAP alpha -VL FAP alpha -VH CD3-VL CD3 or VL FAP alpha -VH FAP alpha -VH CD3-VL CD3. More preferred, the binding domains are arranged in the order VL FAP alpha -VH FAP alpha -VH CD3-VL CD3.

It is preferred for the bispecific single chain antibody comprising a first domain binding domain capable of binding to CD3 epsilon (CD3ε) of human and non-chimpanzee primate and a second domain binding domain capable of binding to the extracellular domain of the mutated human FAPα chimera that the first domain capable of binding to an epitope of human and non-chimpanzee primate CD3ε chain comprises an amino acid sequence selected from the group consisting of SEQ ID NOs: 23, 25, 41, 43, 59, 61, 77, 79, 95, 97, 113, 115, 131, 133, 149, 151, 167, 169, 185 or 187.

A particularly preferred embodiment of the invention concerns an above characterized polypeptide, wherein the bispecific single chain antibody molecule comprises a sequence selected from:
(a) an amino acid sequence as depicted in any of SEQ ID NOs. 819, 805, 749, 763, 833, 777 or 791;
(b) an amino acid sequence encoded by a nucleic acid sequence as depicted in any of SEQ ID NOs: 820, 806, 750, 764, 834, 778 or 792; and
(c) an amino acid sequence at least 90% identical, more preferred at least 95 identical, most preferred at least 96% identical to the amino acid sequence of (a) or (b).

The invention relates to a bispecific single chain antibody molecule comprising an amino acid sequence as depicted in any of SEQ ID NOs: 819, 805, 749, 763, 833, 777 or 791, as well as to an amino acid sequences at least 85% identical, preferably 90%, more preferred at least 95% identical, most preferred at least 96, 97, 98, or 99% identical to the amino acid sequence of SEQ ID NOs: 819, 805, 749, 763, 833, 777 or 791. The invention relates also to the corresponding nucleic acid sequences as depicted in any of SEQ ID NOs: 820, 806, 750, 764, 834, 778 or 792, as well as to nucleic acid sequences at least 85% identical, preferably 90%, more preferred at least 95% identical, most preferred at least 96, 97, 98, or 99% identical to the nucleic acid sequences shown in SEQ ID NOs: 820, 806, 750, 764, 834, 778 or 792. Preferred domain arrangements in the FAPα×CD3 bispecific single chain antibody constructs of the invention are shown in the following examples.

In a further alternative embodiment the invention provides a bispecific single chain antibody comprising a first domain binding domain capable of binding to CD3 epsilon (CD3ε) of human and non-chimpanzee primate and a second domain binding domain capable of binding to the four Ig domains (SEQ ID NO: 436), a cystein-rich domain (SEQ ID NO: 437), or the beta-chain of a sema domain (SEQ ID NO: 438) of the extracellular domain of c-MET.

According to a preferred embodiment of the invention an above characterized bispecific single chain antibody molecule comprises a group of the following sequences as CDR H1, CDR H2, CDR H3, CDR L1, CDR L2 and CDR L3 in the second binding domain selected from the group consisting of:
a) CDR H1-3 of SEQ ID NO: 500-502 and CDR L1-3 of SEQ ID NO: 505-507;
b) CDR H1-3 of SEQ ID NO: 514-516 and CDR L1-3 of SEQ ID NO: 519-521;
c) CDR H1-3 of SEQ ID NO: 528-530 and CDR L1-3 of SEQ ID NO: 533-535;
d) CDR H1-3 of SEQ ID NO: 542-544 and CDR L1-3 of SEQ ID NO: 547-549;
e) CDR H1-3 of SEQ ID NO: 556-558 and CDR L1-3 of SEQ ID NO: 561-563;
f) CDR H1-3 of SEQ ID NO: 570-572 and CDR L1-3 of SEQ ID NO: 575-577;
g) CDR H1-3 of SEQ ID NO: 584-586 and CDR L1-3 of SEQ ID NO: 589-591;
h) CDR H1-3 of SEQ ID NO: 598-600 and CDR L1-3 of SEQ ID NO: 603-605;
i) CDR H1-3 of SEQ ID NO: 612-614 and CDR L1-3 of SEQ ID NO: 617-619;
j) CDR H1-3 of SEQ ID NO: 626-628 and CDR L1-3 of SEQ ID NO: 631-633;
k) CDR H1-3 of SEQ ID NO: 640-642 and CDR L1-3 of SEQ ID NO: 645-647;
l) CDR H1-3 of SEQ ID NO: 654-656 and CDR L1-3 of SEQ ID NO: 659-661;
m) CDR H1-3 of SEQ ID NO: 668-670 and CDR L1-3 of SEQ ID NO: 673-675;
n) CDR H1-3 of SEQ ID NO: 682-684 and CDR L1-3 of SEQ ID NO: 687-689;
o) CDR H1-3 of SEQ ID NO: 696-698 and CDR L1-3 of SEQ ID NO: 701-703;
p) CDR H1-3 of SEQ ID NO: 710-712 and CDR L1-3 of SEQ ID NO: 715-717; and
q) CDR H1-3 of SEQ ID NO: 724-726 and CDR L1-3 of SEQ ID NO: 729-731.

The sequences of the corresponding VL- and VH-regions of the second binding domain of the bispecific single chain antibody molecule of the invention as well as of the respective scFvs are shown in the sequence listing.

In the bispecific single chain antibody molecule of the invention the binding domains are arranged in the order VL-VH-VH-VL, VL-VH-VL-VH, VH-VL-VH-VL or VH-VL-VL-VH, as exemplified in the appended examples. Preferably, the binding domains are arranged in the order VH C-MET-VL C-MET-VH CD3-VL CD3 or VL C-MET-VH C-MET-VH CD3-VL CD3.

More preferably, the first domain capable of binding to an epitope of human and non-chimpanzee primate CD3ε chain comprises an amino acid sequence selected from the group consisting of SEQ ID NOs: 23, 25, 41, 43, 59, 61, 77, 79, 95, 97, 113, 115, 131, 133, 149, 151, 167, 169, 185 or 187.

A particularly preferred embodiment of the invention concerns an above characterized polypeptide, wherein the bispecific single chain antibody molecule comprises a sequence selected from:
(a) an amino acid sequence as depicted in any of SEQ ID NOs. 511, 525, 539, 553, 567 or 581;
(b) an amino acid sequence encoded by a nucleic acid sequence as depicted in any of SEQ ID NOs: 512, 526, 540, 554, 568 or 582; and
(c) an amino acid sequence at least 90% identical, more preferred at least 95% identical, most preferred at least 96% identical to the amino acid sequence of (a) or (b).

The invention relates to a bispecific single chain antibody molecule comprising an amino acid sequence as depicted in any of SEQ ID NOs: 511, 525, 539, 553, 567 or 581, as well as to an amino acid sequences at least 85% identical, preferably 90%, more preferred at least 95% identical, most preferred at least 96, 97, 98, or 99% identical to the amino acid sequence of SEQ ID NOs: 511, 525, 539, 553, 567 or 581. The invention relates also to the corresponding nucleic acid sequences as depicted in any of SEQ ID NOs: 512, 526, 540, 554, 568 or 582 as well as to nucleic acid sequences at least 85% identical, preferably 90%, more preferred at least 95% identical, most preferred at least 96, 97, 98, or 99% identical to the nucleic acid sequences shown in SEQ ID NOs: 512, 526, 540, 554, 568 or 582.

Preferred domain arrangements in the c-METxCD3 bispecific single chain antibody constructs of the invention are shown in the following examples.

According to an alternative embodiment the invention provides a bispecific single chain antibody comprising a first domain binding domain capable of binding to CD3 epsilon (CD3ε) of human and non-chimpanzee primate and a second domain binding domain capable of binding to the mucin domain (SEQ ID NO: 440), the three EGF-like domains (SEQ ID NO: 441), or the Sushi/SCR/CCP domain (SEQ ID NO: 442) of the extracellular domain of endosialin (TEM1).

Preferably the first domain capable of binding to an epitope of human and non-chimpanzee primate CD3ε chain comprises an amino acid sequence selected from the group consisting of SEQ ID NOs: 23, 25, 41, 43, 59, 61, 77, 79, 95, 97, 113, 115, 131, 133, 149, 151, 167, 169, 185 or 187.

Moreover, in an alternative embodiment the invention provides a bispecific single chain antibody comprising a first domain binding domain capable of binding to CD3 epsilon (CD3ε) of human and non-chimpanzee primate and a second domain binding domain capable of binding to the three fibronectin type III domains (SEQ ID NO: 444), the L2 domain (SEQ ID NO: 445) of the extracellular domain of IGF-1R. According to a preferred embodiment of the invention an above characterized bispecific single chain antibody molecule comprises a group of the following sequences as CDR H1, CDR H2, CDR H3, CDR L1, CDR L2 and CDR L3 in the second binding domain selected from the group consisting of:

a) CDR H1-3 of SEQ ID NO: 836-838 and CDR L1-3 of SEQ ID NO: 841-843; and
b) CDR H1-3 of SEQ ID NO: 850-852 and CDR L1-3 of SEQ ID NO: 855-857.

The sequences of the corresponding VL- and VH-regions of the second binding domain of the bispecific single chain antibody molecule of the invention as well as of the respective scFvs are shown in the sequence listing.

In the bispecific single chain antibody molecule of the invention the binding domains are arranged in the order VL-VH-VH-VL, VL-VH-VL-VH, VH-VL-VH-VL or VH-VL-VL-VH, as exemplified in the appended examples. Preferably, the binding domains are arranged in the order VH IGF-1R-VL IGF-1R-VH CD3-VL CD3 or VL IGF-1R-VH IGF-1R-VH CD3-VL CD3.

Preferably, the first domain capable of binding to an epitope of human and non-chimpanzee primate CD3ε chain comprises an amino acid sequence selected from the group consisting of SEQ ID NOs: 23, 25, 41, 43, 59, 61, 77, 79, 95, 97, 113, 115, 131, 133, 149, 151, 167, 169, 185 or 187.

A particularly preferred embodiment of the invention concerns an above characterized polypeptide, wherein the bispecific single chain antibody molecule comprises a sequence selected from:

(a) an amino acid sequence as depicted in any of SEQ ID NOs: 847 or 861, (b) an amino acid sequence encoded by a nucleic acid sequence as depicted in any of SEQ ID NOs: 848, or 862; and (c) an amino acid sequence at least 90% identical, more preferred at least 95% identical, most preferred at least 96% identical to the amino acid sequence of (a) or (b).

The invention relates to a bispecific single chain antibody molecule comprising an amino acid sequence as depicted in any of SEQ ID NOs: 847 or 861, as well as to an amino acid sequences at least 85% identical, preferably 90%, more preferred at least 95% identical, most preferred at least 96, 97, 98, or 99% identical to the amino acid sequence of SEQ ID NOs: 847 or 861. The invention relates also to the corresponding nucleic acid sequences as depicted in any of SEQ ID NOs: 848, or 862 as well as to nucleic acid sequences at least 85% identical, preferably 90%, more preferred at least 95% identical, most preferred at least 96, 97, 98, or 99 identical to the nucleic acid sequences shown in SEQ ID NOs: 848, or 862. Preferred domain arrangements in the IGF-1RxCD3 bispecific single chain antibody constructs of the invention are shown in the following examples.

The invention relates to bispecific single chain antibody molecule comprising the above identified amino acid sequences, as well as to amino acid sequences at least 85% identical, preferably 90%, more preferred at least 95% identical, most preferred at least 96, 97, 98, or 99% identical to the amino acid sequence of said sequences. As described herein above, the specificity of an antibody is generally understood to be determined by the CDR sequences. Accordingly, in order to maintain the specificity of a given group of CDRs, e.g three CDRs of a heavy chain and three CDRs of a light chain, the sequence of these CDRs has to be conserved. Accordingly variants of bispecific single antibodies as identified herein, which also fall under the present invention are preferably variants having more than one amino acid substitutions in FR regions instead of the CDRs. It is to be understood that the sequence identity is determined over the entire nucleotide or amino acid sequence. For sequence alignments, for example, the programs Gap or BestFit can be used (Needleman and Wunsch J. Mol. Biol. 48 (1970), 443-453; Smith and Waterman, Adv. Appl. Math 2 (1981), 482-489), which is contained in the GCG software package (Genetics Computer Group, 575 Science Drive, Madison, Wis., USA 53711 (1991). It is a routine method for those skilled in the art to determine and identify a nucleotide or amino acid sequence having e.g. 85% (90%, 95%, 96%, 97%, 98% or 99%) sequence identity to the nucleotide or amino acid sequences of the bispecific single chain antibody of the invention by using e.g. one of the above mentioned programs. For example, according to Crick's Wobble hypothesis, the 5' base on the anti-codon is not as spatially confined as the other two bases, and could thus have non-standard base pairing. Put in other words: the third position in a codon triplet may vary so that two triplets which differ in this third position may encode the same amino acid residue. Said hypothesis is well known to the person skilled in the art (see e.g. http://en.wikipedia.org/wiki/Wobble_Hypothesis; Crick, J Mol Biol 19 (1966): 548-55).

In an alternative embodiment the present invention provides a nucleic acid sequence encoding an above described bispecific single chain antibody molecule of the invention.

The present invention also relates to a vector comprising the nucleic acid molecule of the present invention.

Many suitable vectors are known to those skilled in molecular biology, the choice of which would depend on the function desired and include plasmids, cosmids, viruses, bacteriophages and other vectors used conventionally in genetic engineering. Methods which are well known to those skilled in the art can be used to construct various plasmids and vectors; see, for example, the techniques described in Sambrook et al. (loc cit.) and Ausubel, Current Protocols in Molecular Biology, Green Publishing Associates and Wiley Interscience, N.Y. (1989), (1994). Alternatively, the polynucleotides and vectors of the invention can be reconstituted into liposomes for delivery to target cells. As discussed in further details below, a cloning vector was used to isolate individual sequences of DNA. Relevant sequences can be transferred into expression vectors where expression of a particular polypeptide is required. Typical cloning vectors include pBluescript SK, pGEM, pUC9, pBR322 and pGBT9. Typical expression vectors include pTRE, pCAL-n-EK, pESP-1, pOP13CAT.

Preferably said vector comprises a nucleic acid sequence which is a regulatory sequence operably linked to said nucleic acid sequence defined herein.

The term "regulatory sequence" refers to DNA sequences, which are necessary to effect the expression of coding sequences to which they are ligated. The nature of such control sequences differs depending upon the host organism. In prokaryotes, control sequences generally include promoter, ribosomal binding site, and terminators. In eukaryotes generally control sequences include promoters, terminators and, in some instances, enhancers, transactivators or transcription factors. The term "control sequence" is intended to include, at a minimum, all components the presence of which are necessary for expression, and may also include additional advantageous components.

The term "operably linked" refers to a juxtaposition wherein the components so described are in a relationship permitting them to function in their intended manner. A control sequence "operably linked" to a coding sequence is ligated in such a way that expression of the coding sequence is achieved under conditions compatible with the control sequences. In case the control sequence is a promoter, it is obvious for a skilled person that double-stranded nucleic acid is preferably used.

Thus, the recited vector is preferably an expression vector. An "expression vector" is a construct that can be used to transform a selected host and provides for expression of a coding sequence in the selected host. Expression vectors can for instance be cloning vectors, binary vectors or integrating vectors. Expression comprises transcription of the nucleic acid molecule preferably into a translatable mRNA. Regulatory elements ensuring expression in prokaryotes and/or eukaryotic cells are well known to those skilled in the art. In the case of eukaryotic cells they comprise normally promoters ensuring initiation of transcription and optionally poly-A signals ensuring termination of transcription and stabilization of the transcript. Possible regulatory elements permitting expression in prokaryotic host cells comprise, e.g., the $P_L$, lac, trp or tac promoter in *E. coli*, and examples of regulatory elements permitting expression in eukaryotic host cells are the AOX1 or GAL1 promoter in yeast or the CMV-, SV40-, RSV-promoter (Rous sarcoma virus), CMV-enhancer, SV40-enhancer or a globin intron in mammalian and other animal cells.

Beside elements, which are responsible for the initiation of transcription such regulatory elements may also comprise transcription termination signals, such as the SV40-poly-A site or the tk-poly-A site, downstream of the polynucleotide. Furthermore, depending on the expression system used leader sequences capable of directing the polypeptide to a cellular compartment or secreting it into the medium may be added to the coding sequence of the recited nucleic acid sequence and are well known in the art; see also the appended Examples. The leader sequence(s) is (are) assembled in appropriate phase with translation, initiation and termination sequences, and preferably, a leader sequence capable of directing secretion of translated protein, or a portion thereof, into the periplasmic space or extracellular medium. Optionally, the heterologous sequence can encode a fusion protein including an N-terminal identification peptide imparting desired characteristics, e.g., stabilization or simplified purification of expressed recombinant product; see supra. In this context, suitable expression vectors are known in the art such as Okayama-Berg cDNA expression vector pcDV1 (Pharmacia), pCDM8, pRc/CMV, pcDNA1, pcDNA3 (Invitrogene), pEF-DHFR, pEF-ADA or pEF-neo (Mack et al. PNAS (1995) 92, 7021-7025 and Raum et al. Cancer Immunol Immunother (2001) 50(3), 141-150) or pSPORT1 (GIBCO BRL).

Preferably, the expression control sequences will be eukaryotic promoter systems in vectors capable of transforming of transfecting eukaryotic host cells, but control sequences for prokaryotic hosts may also be used. Once the vector has been incorporated into the appropriate host, the host is maintained under conditions suitable for high level expression of the nucleotide sequences, and as desired, the collection and purification of the bispecific single chain antibody molecule of the invention may follow; see, e.g., the appended examples.

An alternative expression system, which can be used to express a cell cycle interacting protein is an insect system. In one such system, *Autographa californica* nuclear polyhedrosis virus (AcNPV) is used as a vector to express foreign genes in *Spodoptera frugiperda* cells or in *Trichoplusia* larvae. The coding sequence of a recited nucleic acid molecule may be cloned into a nonessential region of the virus, such as the polyhedrin gene, and placed under control of the polyhedrin promoter. Successful insertion of said coding sequence will render the polyhedrin gene inactive and produce recombinant virus lacking coat protein coat. The recombinant viruses are then used to infect *S. frugiperda* cells or *Trichoplusia* larvae in which the protein of the invention is expressed (Smith, J. Virol. 46 (1983), 584; Engelhard, Proc. Nat. Acad. Sci. USA 91 (1994), 3224-3227).

Additional regulatory elements may include transcriptional as well as translational enhancers. Advantageously, the above-described vectors of the invention comprise a selectable and/or scorable marker.

Selectable marker genes useful for the selection of transformed cells and, e.g., plant tissue and plants are well known to those skilled in the art and comprise, for example, antimetabolite resistance as the basis of selection for dhfr, which confers resistance to methotrexate (Reiss, Plant Physiol. (Life Sci. Adv.) 13 (1994), 143-149); npt, which confers resistance to the aminoglycosides neomycin, kanamycin and paromycin (Herrera-Estrella, EMBO J. 2 (1983), 987-995) and hygro, which confers resistance to hygromycin (Marsh, Gene 32 (1984), 481-485). Additional selectable genes have been described, namely trpB, which allows cells to utilize indole in place of tryptophan; hisD, which allows cells to utilize histinol in place of histidine (Hartman, Proc. Natl. Acad. Sci. USA 85 (1988), 8047); mannose-6-phosphate isomerase which allows cells to utilize mannose (WO 94/20627) and ODC (ornithine decarboxylase) which confers resistance to the ornithine decarboxylase inhibitor, 2-(difluoromethyl)-DL-ornithine, DFMO (McConlogue, 1987, In: Current Communications in Molecular Biology, Cold Spring Harbor Laboratory ed.) or deaminase from *Aspergillus terreus* which confers resistance to Blasticidin S (Tamura, Biosci. Biotechnol. Biochem. 59 (1995), 2336-2338).

Useful scorable markers are also known to those skilled in the art and are commercially available. Advantageously, said marker is a gene encoding luciferase (Giacomin, Pl. Sci. 116 (1996), 59-72; Scikantha, J. Bact. 178 (1996), 121), green fluorescent protein (Gerdes, FEBS Lett. 389 (1996), 44-47) or β-glucuronidase (Jefferson, EMBO J. 6 (1987), 3901-3907). This embodiment is particularly useful for simple and rapid screening of cells, tissues and organisms containing a recited vector.

As described above, the recited nucleic acid molecule can be used alone or as part of a vector to express the bispecific single chain antibody molecule of the invention in cells, for, e.g., purification but also for gene therapy purposes. The nucleic acid molecules or vectors containing the DNA sequence(s) encoding any one of the above described bispecific single chain antibody molecule of the invention is introduced into the cells which in turn produce the polypeptide of interest. Gene therapy, which is based on introducing therapeutic genes into cells by ex-vivo or in-vivo techniques is one of the most important applications of gene transfer. Suitable vectors, methods or gene-delivery systems for in-vitro or in-vivo gene therapy are described in the literature and are known to the person skilled in the art; see, e.g., Giordano, Nature Medicine 2 (1996), 534-539; Schaper, Circ. Res. 79 (1996), 911-919; Anderson, Science 256 (1992), 808-813; Verma, Nature 389 (1994), 239; Isner, Lancet 348 (1996), 370-374; Muhlhauser, Circ. Res. 77 (1995), 1077-1086; Onodera, Blood 91 (1998), 30-36; Verma, Gene Ther. 5 (1998), 692-699; Nabel, Ann. N.Y. Acad. Sci. 811 (1997), 289-292; Verzeletti, Hum. Gene Ther. 9 (1998), 2243-51; Wang, Nature Medicine 2 (1996), 714-716; WO 94/29469; WO 97/00957, U.S. Pat. No. 5,580,859; U.S. Pat. No. 5,589, 466; or Schaper, Current Opinion in Biotechnology 7 (1996), 635-640; dos Santos Coura and Nardi Virol J. (2007), 4:99. The recited nucleic acid molecules and vectors may be designed for direct introduction or for introduction via liposomes, or viral vectors (e.g., adenoviral, retroviral) into the cell. Preferably, said cell is a germ line cell, embryonic cell, or egg cell or derived there from, most preferably said cell is a stem cell. An example for an embryonic stem cell can be, inter alia, a stem cell as described in Nagy, Proc. Natl. Acad. Sci. USA 90 (1993), 8424-8428.

The invention also provides for a host transformed or transfected with a vector of the invention. Said host may be produced by introducing the above described vector of the invention or the above described nucleic acid molecule of the invention into the host. The presence of at least one vector or at least one nucleic acid molecule in the host may mediate the expression of a gene encoding the above described single chain antibody constructs.

The described nucleic acid molecule or vector of the invention, which is introduced in the host may either integrate into the genome of the host or it may be maintained extrachromosomally.

The host can be any prokaryote or eukaryotic cell.

The term "prokaryote" is meant to include all bacteria, which can be transformed or transfected with DNA or RNA molecules for the expression of a protein of the invention. Prokaryotic hosts may include gram negative as well as gram positive bacteria such as, for example, *E. coli, S. typhimurium, Serratia marcescens* and *Bacillus subtilis*. The term "eukaryotic" is meant to include yeast, higher plant, insect and preferably mammalian cells. Depending upon the host employed in a recombinant production procedure, the protein encoded by the polynucleotide of the present invention may be glycosylated or may be non-glycosylated. Especially preferred is the use of a plasmid or a virus containing the coding sequence of the bispecific single chain antibody molecule of the invention and genetically fused thereto an N-terminal FLAG-tag and/or C-terminal His-tag. Preferably, the length of said FLAG-tag is about 4 to 8 amino acids, most preferably 8 amino acids. An above described polynucleotide can be used to transform or transfect the host using any of the techniques commonly known to those of ordinary skill in the art. Furthermore, methods for preparing fused, operably linked genes and expressing them in, e.g., mammalian cells and bacteria are well-known in the art (Sambrook, loc cit.). Preferably, said host is a bacterium or an insect, fungal, plant or animal cell.

It is particularly envisaged that the recited host may be a mammalian cell. Particularly preferred host cells comprise CHO cells, COS cells, myeloma cell lines like SP2/0 or NS/0. As illustrated in the appended examples, particularly preferred are CHO-cells as hosts.

More preferably said host cell is a human cell or human cell line, e.g. per.c6 (Kroos, Biotechnol. Prog., 2003, 19:163-168).

In a further embodiment, the present invention thus relates to a process for the production of a bispecific single chain antibody molecule of the invention, said process comprising culturing a host of the invention under conditions allowing the expression of the bispecific single chain antibody molecule of the invention and recovering the produced polypeptide from the culture.

The transformed hosts can be grown in fermentors and cultured according to techniques known in the art to achieve optimal cell growth. The bispecific single chain antibody molecule of the invention can then be isolated from the growth medium, cellular lysates, or cellular membrane fractions. The isolation and purification of the, e.g., microbially expressed bispecific single chain antibody molecules may be by any conventional means such as, for example, preparative chromatographic separations and immunological separations such as those involving the use of monoclonal or polyclonal antibodies directed, e.g., against a tag of the bispecific single chain antibody molecule of the invention or as described in the appended examples.

The conditions for the culturing of a host, which allow the expression are known in the art to depend on the host system and the expression system/vector used in such process. The parameters to be modified in order to achieve conditions allowing the expression of a recombinant polypeptide are known in the art. Thus, suitable conditions can be determined by the person skilled in the art in the absence of further inventive input.

Once expressed, the bispecific single chain antibody molecule of the invention can be purified according to standard procedures of the art, including ammonium sulfate precipitation, affinity columns, column chromatography, gel electrophoresis and the like; see, Scopes, "Protein Purification", Springer-Verlag, N.Y. (1982). Substantially pure polypeptides of at least about 90 to 95% homogeneity are preferred, and 98 to 99% or more homogeneity are most preferred, for pharmaceutical uses. Once purified, partially or to homogeneity as desired, the bispecific single chain antibody molecule of the invention may then be used therapeutically (including extracorporeally) or in developing and performing assay procedures. Furthermore, examples for methods for the recovery of the bispecific single chain antibody molecule of the invention from a culture are described in detail in the appended examples.

Furthermore, the invention provides for a composition comprising a bispecific single chain antibody molecule of the invention or a bispecific single chain antibody as produced by the process disclosed above. Preferably, said composition is a pharmaceutical composition.

The invention provides also for a bispecific single chain antibody molecule as defined herein, or produced according to the process as defined herein, wherein said bispecific single chain antibody molecule is for use in the prevention, treatment or amelioration of cancer. Preferably, said cancer is a solid tumor, more preferably a carcinoma or prostate cancer. It is preferred that the bispecific single chain is further comprising suitable formulations of carriers, stabilizers and/or excipients. Moreover, it is preferred that said bispecific single chain antibody molecule is suitable to be administered in combination with an additional drug. Said drug may be a non-proteinaceous compound or a proteinaceous compound and may be administered simultaneously or non-simultaneously with the bispecific single chain antibody molecule as defined herein.

In accordance with the invention, the term "pharmaceutical composition" relates to a composition for administration to a patient, preferably a human patient. The particular preferred pharmaceutical composition of this invention comprises bispecific single chain antibodies directed against and generated against context-independent CD3 epitopes. Preferably, the pharmaceutical composition comprises suitable formulations of carriers, stabilizers and/or excipients. In a preferred embodiment, the pharmaceutical composition comprises a composition for parenteral, transdermal, intraluminal, intraarterial, intrathecal and/or intranasal administration or by direct injection into tissue. It is in particular envisaged that said composition is administered to a patient via infusion or injection. Administration of the suitable compositions may be effected by different ways, e.g., by intravenous, intraperitoneal, subcutaneous, intramuscular, topical or intradermal administration. In particular, the present invention provides for an uninterrupted administration of the suitable composition. As a non-limiting example, uninterrupted, i.e. continuous administration may be realized by a small pump system worn by the patient for metering the influx of therapeutic agent into the body of the patient. The pharmaceutical composition comprising the bispecific single chain antibodies directed against and generated against context-independent CD3 epitopes of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of these bispecific single chain antibodies directed against and generated against context-independent CD3 epitopes of this invention may be intravenuous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

The composition of the present invention, comprising in particular bispecific single chain antibodies preferably directed against and generated against context-independent CD3 epitopes may further comprise a pharmaceutically acceptable carrier. Examples of suitable pharmaceutical carriers are well known in the art and include solutions, e.g. phosphate buffered saline solutions, water, emulsions, such as oil/water emulsions, various types of wetting agents, sterile solutions, liposomes, etc. Compositions comprising such carriers can be formulated by well known conventional methods. Formulations can comprise carbohydrates, buffer solutions, amino acids and/or surfactants. Carbohydrates may be non-reducing sugars, preferably trehalose, sucrose, octasulfate, sorbitol or xylitol. Such formulations may be used for continuous administrations which may be intravenuous or subcutaneous with and/or without pump systems. Amino acids may be charged amino acids, preferably lysine, lysine acetate, arginine, glutamate and/or histidine. Surfactants may be detergents, preferably with a molecular weight of >1.2 KD and/or a polyether, preferably with a molecular weight of >3 KD. Non-limiting examples for preferred detergents are Tween 20, Tween 40, Tween 60, Tween 80 or Tween 85. Non-limiting examples for preferred polyethers are PEG 3000, PEG 3350, PEG 4000 or PEG 5000. Buffer systems used in the present invention can have a preferred pH of 5-9 and may comprise citrate, succinate, phosphate, histidine and acetate. The compositions of the present invention can be administered to the subject at a suitable dose which can be determined e.g. by dose escalating studies by administration of increasing doses of the bispecific single chain antibody molecule of the invention exhibiting cross-species specificity described herein to non-chimpanzee primates, for instance macaques. As set forth above, the bispecific single chain antibody molecule of the invention exhibiting cross-species specificity described herein can be advantageously used in identical form in preclinical testing in non-chimpanzee primates and as drug in humans. These compositions can also be administered in combination with other proteinaceous and non-proteinaceous drugs. These drugs may be administered simultaneously with the composition comprising the bispecific single chain antibody molecule of the invention as defined herein or separately before or after administration of said polypeptide in timely defined intervals and doses. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently. Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives may also be present such as, for example, antimicrobials, anti-oxidants, chelating agents, inert gases and the like. In addition, the composition of the present invention might comprise proteinaceous carriers, like, e.g., serum albumin or immunoglobulin, preferably of human origin. It is envisaged that the composition of the invention might comprise, in addition to the bispecific single chain antibody molecule of the invention defined herein, further biologically active agents, depending on the intended use of the composition. Such agents might be drugs acting on the gastrointestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various cancer specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that effect the ability of a particular drug to treat a given condition, is established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" means the time where 50% of an administered drug are eliminated through biological processes, e.g. metabolism, excretion, etc.

By "hepatic first-pass metabolism" is meant the propensity of a drug to be metabolized upon first contact with the liver, i.e. during its first pass through the liver. "Volume of distribution" means the degree of retention of a drug throughout the various compartments of the body, like e.g. intracellular and extracellular spaces, tissues and organs, etc. and the distribution of the drug within these compartments. "Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered.

"Bioavailability" means the amount of a drug in the blood compartment.

"Lag time" means the time delay between the administration of the drug and its detection and measurability in blood or plasma.

"Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetik parameters of bispecific single chain antibodies exhibiting cross-species specificity, which may be determined in preclinical animal testing in non-chimpanzee primates as outlined above are also set forth e.g. in the publication by Schlereth et al. (Cancer Immunol. Immunother. 20 (2005), 1-12).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviating to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance haematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The term "effective and non-toxic dose" as used herein refers to a tolerable dose of the bispecific single chain antibody as defined herein which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

Moreover, the invention relates to a pharmaceutical composition comprising a bispecific single chain antibody molecule of this invention or produced according to the process according to the invention for the prevention, treatment or amelioration of cancer or an autoimmune disease. Preferably, said cancer is a:
(a) a solid tumor, more preferably a carcinoma or prostate cancer;
(b) a carcinoma, sarcoma, glioblastoma/astrocytoma, melanoma, mesothelioma, Wilms tumor or a hematopoietic malignancy such as leukemia, lymphoma or multiple myeloma;
(c) carcinomas (breast, kidney, lung, colorectal, colon, pancreas mesothelioma), sarcomas, and neuroectodermal tumors (melanoma, glioma, neuroblastoma);
(d) epithelial cancer; or
(e) bone or soft tissue cancer (e.g. Ewing sarcoma), breast, liver, lung, head and neck, colorectal, prostate, leiomyosarcoma, cervical and endometrial cancer, ovarian, prostate, and pancreatic cancer.

Preferably, said pharmaceutical composition further comprises suitable formulations of carriers, stabilizers and/or excipients.

A further aspect of the invention relates to a use of a bispecific single chain antibody molecule/polypeptide as defined herein above or produced according to a process defined herein above, for the preparation of a pharmaceutical composition for the prevention, treatment or amelioration of a disease. Preferably, said disease is cancer. More preferably, said cancer is a solid tumor, preferably a carcinoma or prostate cancer.

In another preferred embodiment of use of the bispecific single chain antibody molecule of the invention said pharmaceutical composition is suitable to be administered in combination with an additional drug, i.e. as part of a co-therapy. In said co-therapy, an active agent may be optionally included in the same pharmaceutical composition as the bispecific single chain antibody molecule of the invention, or may be included in a separate pharmaceutical composition. In this latter case, said separate pharmaceutical composition is suitable for administration prior to, simultaneously as or following administration of said pharmaceutical composition comprising the bispecific single chain antibody molecule of the invention. The additional drug or pharmaceutical composition may be a non-proteinaceous compound or a proteinaceous compound. In the case that the additional drug is a proteinaceous compound, it is advantageous that the proteinaceous compound be capable of providing an activation signal for immune effector cells.

Preferably, said proteinaceous compound or non-proteinaceous compound may be administered simultaneously or non-simultaneously with the bispecific single chain antibody molecule of the invention, a nucleic acid molecule as defined hereinabove, a vector as defined as defined hereinabove, or a host as defined as defined hereinabove.

Another aspect of the invention relates to a method for the prevention, treatment or amelioration of a disease in a subject in the need thereof, said method comprising the step of administration of an effective amount of a pharmaceutical composition of the invention. Preferably, said disease is cancer or an autoimmune disease. Preferably, said cancer is
(a) a solid tumor, more preferably a carcinoma or prostate cancer;
(b) a carcinoma, sarcoma, glioblastoma/astrocytoma, melanoma, mesothelioma, Wilms tumor or a hematopoietic malignancy such as leukemia, lymphoma or multiple myeloma;
(c) carcinomas (breast, kidney, lung, colorectal, colon, pancreas mesothelioma), sarcomas, and neuroectodermal tumors (melanoma, glioma, neuroblastoma);
(d) epithelial cancer; or
(e) bone or soft tissue cancer (e.g. Ewing sarcoma), breast, liver, lung, head and neck, colorectal, prostate, leiomyosarcoma, cervical and endometrial cancer, ovarian, prostate, and pancreatic cancer.

In another preferred embodiment of the method of the invention said pharmaceutical composition is suitable to be administered in combination with an additional drug, i.e. as part of a co-therapy. In said co-therapy, an active agent may be optionally included in the same pharmaceutical composition as the bispecific single chain antibody molecule of the invention, or may be included in a separate pharmaceutical composition. In this latter case, said separate pharmaceutical composition is suitable for administration prior to, simultaneously as or following administration of said pharmaceutical composition comprising the bispecific single chain antibody molecule of the invention. The additional drug or pharmaceutical composition may be a non-proteinaceous compound or a proteinaceous compound. In the case that the additional drug is a proteinaceous compound, it is advantageous that the proteinaceous compound be capable of providing an activation signal for immune effector cells.

Preferably, said proteinaceous compound or non-proteinaceous compound may be administered simultaneously or non-simultaneously with the bispecific single chain antibody molecule of the invention, a nucleic acid molecule as defined hereinabove, a vector as defined as defined hereinabove, or a host as defined as defined hereinabove.

It is preferred for the above described method of the invention that said subject is a human.

In a further aspect, the invention relates to a kit comprising a bispecific single chain antibody molecule of the invention, a nucleic acid molecule of the invention, a vector of the invention, or a host of the invention.

These and other embodiments are disclosed and encompassed by the description and Examples of the present invention. Recombinant techniques and methods in immunology are described e.g. in Sambrook et al. Molecular Cloning: A Laboratory Manual; Cold Spring Harbor Laboratory Press, 3$^{rd}$ edition 2001; Lefkovits; Immunology Methods Manual; The Comprehensive Sourcebook of Techniques; Academic Press, 1997; Golemis; Protein-Protein Interactions: A Molecular Cloning Manual; Cold Spring Laboratory Press, 2002. Further literature concerning any one of the antibodies, methods, uses and compounds to be employed in accordance with the present invention may be retrieved from public libraries and databases, using for example electronic devices. For example, the public database "Medline", available on the Internet, may be utilized. Further databases and addresses are known to the person skilled in the art.

The figures show:

FIG. 1

Flowcytometry of CHO cells transfected with native human EpCAM (positive control) and different EpCAM-hNG2 fusion proteins, respectively. Staining with the murine parental IgG1 antibody MAb 5-10 (bold lines) directed against human EpCAM was performed as described (Brischwein (2007) J Immunother 30: 798-807). PBS/2% FCS instead of MAb 5-10 was used as negative control (thin lines).

FIG. 2

T cell cytotoxicity redirected by bscAb 5-10×I2C against CHO cells transfected with human EpCAM (positive control) and different EpCAM-hNG2 fusion proteins as measured in a chromium 51 ($^{51}$Cr) release assay (y-axis). Stimulated human CD4/CD56 depleted PBMC served as effector T cells. Effector- to target cell ratio was 10:1. BscAb 5-10×I2C was used as culture supernatant at different dilutions as indicated on the x-axis. Assay duration was 18 hours.

FIG. 3

Amino acid sequence alignment of full-length mature human (SEQ ID NO: 202) and rat (SEQ ID NO: 206, residues 1-732) PSMA. Mismatching homologous amino acid positions are underlined and highlighted by bold character style. Numbering of amino acid positions refers to human PSMA (SEQ ID NO: 202) and starts with the amino acid methionine encoded by the start codon of human PSMA. Intracellular domain aa 1-aa 19; transmembrane domain aa 20-aa 43; extracellular domain aa 44-aa 750.

FIG. 4

FACS binding analysis of I2C-based anti-human PSMA-bscAbs on CHO cells transfected with (unmutated) human PSMA, rat PSMA mutated to the homologous human amino acid at every mismatched amino acid position with a membrane-distance of ≥60 Å, and unmutated rat PSMA. The bold lines show staining by cell culture supernatant of CHO cells transfected with PSMA-directed bispecific antibody constructs. Cell culture supernatant of untransfected CHO cells served as negative control (thin lines). PSMA-directed bscAbs P1×I2C, P2×I2C, P3×I2C, P4×I2C and P5×I2C bind to (unmutated) human PSMA but neither to unmutated nor to mutated rat PSMA and thus confirms a membrane-distance of <60 Å for the PSMA-epitope of each of these bispecific constructs. By contrast, PSMA-directed bscAbs D1×I2C and D2×I2C do not bind to unmutated rat PSMA but to (unmutated) human and mutated rat PSMA consistent with PSMA-epitopes of a membrane-distance ≥60 Å.

FIG. 5

T cell cytotoxicity redirected by I2C-based PSMA-directed bscAbs to CHO cells transfected with human PSMA as measured in a chromium 51 ($^{51}$Cr) release assay. As source of effector T cells stimulated human CD4/CD56 depleted PBMC were used. The effector-to-target cell ratio was 10:1. PSMA-directed bscAbs were used as cell culture supernatants from transfected CHO cells at different dilutions as indicated. The assay duration was 18 hours. PSMA-directed bscAbs P1×I2C, P2×I2C, P3×I2C, P4×I2C and P5×I2C, whose PSMA-epitopes have a membrane-distance of <60 Å are substantially more potent in redirecting T cell cytotoxicity than PSMA-directed bscAbs D1×I2C and D2×I2C, whose PSMA-epitopes have a membrane-distance of 60 Å.

FIG. 6

FACS binding analysis of I2C-based anti-human PSMA-bscAbs on CHO cells transfected with (unmutated) human PSMA, rat PSMA mutated to the homologous human amino acid at every mismatched amino acid position with a membrane-distance of ≥60 Å, and unmutated rat PSMA. The bold lines show staining by cell culture supernatant of CHO cells transfected with PSMA-directed bispecific antibody constructs. Cell culture supernatant of untransfected CHO cells served as negative control (thin lines). The PSMA-directed bscAb P6×I2C binds to (unmutated) human PSMA but neither to unmutated nor to mutated rat PSMA and thus confirms a membrane-distance of <60 Å for the PSMA-epitope of this bispecific construct. By contrast, PSMA-directed bscAb D3×I2C does not bind to unmutated rat PSMA but to (unmutated) human and mutated rat PSMA consistent with a PSMA-epitope of a membrane-distance ≥60 Å.

FIG. 7

T cell cytotoxicity redirected by I2C-based PSMA-directed bscAbs to CHO cells transfected with human PSMA as measured in a chromium 51 ($^{51}$Cr) release assay. As source of effector T cells stimulated human CD4/CD56 depleted PBMC were used. The effector-to-target cell ratio was 10:1. PSMA-directed bscAbs were used as cell culture supernatants from transfected CHO cells at different dilutions as indicated. The assay duration was 18 hours. PSMA-directed bscAb P6×I2C, whose PSMA-epitope has a membrane-distance of <60 Å is substantially more potent in redirecting T cell cytotoxicity than PSMA-directed bscAb D3×I2C, whose PSMA-epitope has a membrane-distance of 60 Å.

FIG. 8

FACS binding analysis of I2C-based bscAbs directed to membrane-proximal PSMA-epitopes on CHO cells transfected with macaque PSMA, the CD3 positive human T cell leukemia cell line HPB-ALL and the CD3 positive macaque T cell line 4119LnPx. The bold lines show staining by cell culture supernatant of CHO cells transfected with designated PSMA-directed bispecific antibody constructs. Cell culture supernatant of untransfected CHO cells served as negative control (thin lines). The designated PSMA-directed bscAbs in addition to human PSMA also bind to macaque PSMA, human CD3 and macaque CD3.

FIG. 9

Amino acid sequence alignment of full-length mature human (SEQ ID NO: 367) and murine (SEQ ID NO: 371, residues 1-761) FAPα. Mismatching homologous amino acid positions are underlined and highlighted by bold character style. Numbering of amino acid positions refers to human FAPalpha (SEQ ID NO: 367) and starts with the amino acid methionine encoded by the start codon of human FAPalpha. Intracellular domain aa 1-aa 9; transmembrane domain aa 10-aa 26; extracellular domain aa 27-aa 760.

FIG. 10

FACS binding analysis of cell surface expression on CHO cells expressing the murine FAPalpha antigen as described in Example 6.3 and CHO cells expressing the mutated human FAPalpha antigen with murine membrane-distal epitopes as described in Example 6.4, respectively. The FACS staining was performed as described in Examples 6.3 and 6.4. The bold lines represent cells incubated with the detection antibodies—the Penta His antibody in case of murine FAPalpha and the anti-FLAG M2 antibody in case of the mutated human FAPalpha antigen with murine membrane-distal epitopes. The thin lines represent the negative controls. For both cell lines the overlay of the histograms for the anti-FLAG M2 antibody and the Penta His antibody, respectively, shows a significant expression level of the respective antigen. Expression levels were comparable for the two cell lines.

FIG. 11

FACS binding analysis of designated bispecific single chain constructs to CHO cells expressing human FAPalpha as described in Example 6.1, the human CD3+ T cell line HPB-ALL, CHO cells expressing macaque FAPalpha as described in Example 6.15 and the macaque T cell line 4119LnPx, respectively. The FACS staining was performed as described in Examples 6.13 and 6.16. The bold lines represent cells incubated with cell culture supernatant of transfected cells expressing the bispecific antibody constructs. The thin lines represent the negative controls. Supernatant of untransfected CHO cells was used as negative control. For each bispecific single chain construct the overlays of the histograms show specific binding of the construct to human and macaque FAPalpha and human and macaque CD3.

FIG. 12

The diagrams show results of chromium release assays measuring cytotoxic activity induced by designated FAPalpha specific single chain constructs redirected to the indicated target cell lines generated as described in Examples 6.1, 6.3 and 6.4. Effector cells were also used as indicated. The assays were performed as described in Example 6.14. The diagrams clearly demonstrate for each construct the potent recruitment of cytotoxic activity of human effector T cells against target cells positive for human FAPalpha and target cells positive for the mutated human FAPalpha antigen with murine membrane-distal epitopes. No significant recruitment of cytotoxic activity of human effector T cells against target cells positive for murine FAPalpha was detectable.

FIG. 13

FACS binding analysis of designated bispecific single chain constructs to CHO cells expressing human c-MET as described in Example 7.17, the human CD3+ T cell line HPB-ALL, CHO cells expressing macaque c-MET as described in Example 7.17 and the macaque T cell line 4119LnPx, respectively. The FACS staining was performed as described in Examples 7.13 and 7.16. The bold lines represent cells incubated with cell culture supernatant of transfected cells expressing the bispecific antibody constructs. The filled histograms show the negative controls. Supernatant of untransfected CHO cells was used as negative control. For each bispecific single chain construct the overlays of the histograms show specific binding of the construct to human and macaque c-MET and human and macaque CD3.

FIG. 14

FACS binding analysis of designated bispecific single chain constructs to CHO cells expressing the murine c-MET antigen as described in Example 7.17, CHO cells expressing the mutated human c-MET antigen with murine membrane-distal epitopes as described in Example 7.17 and CHO cells expressing the mutated murine c-MET antigen with human membrane-distal epitopes as described in Example 7.17, respectively. The FACS staining was performed as described in Example 7.13. The bold lines represent cells incubated with cell culture supernatant of transfected cells expressing the bispecific antibody constructs. The filled histograms show the negative controls. Supernatant of untransfected CHO cells was used as negative control. An anti-FLAG M2 antibody was used to detect expression levels of the respective antigens. For each cell line the overlay of the histograms for the anti-FLAG M2 antibody shows high expression levels of the respective antigen. Expression levels were comparable for the three cell lines. For each bispecific single chain construct the overlays of the histograms show specific binding of the construct to the mutated human c-MET antigen with murine membrane-distal epitopes but not to the mutated murine c-MET antigen with human membrane-distal epitopes and not to the murine c-MET antigen.

FIG. 15

The diagrams show results of chromium release assays measuring cytotoxic activity induced by designated c-MET specific single chain constructs redirected to the indicated target cell lines generated as described in Example 7.17. Effector cells were also used as indicated. The assays were performed as described in Example 7.14. The diagrams clearly demonstrate for each construct the potent recruitment of cytotoxic activity of human effector T cells against target cells positive for human c-MET. No significant recruitment of cytotoxic activity of human effector T cells against target cells positive for murine c-MET and target cells positive for the mutated murine c-MET antigen with human membrane-distal epitopes, respectively, was detectable.

FIG. 16

FACS binding analysis of designated cross-species specific scFv antibodies to CHO cells expressing human c-MET as described in Example 7.17, CHO cells expressing the murine c-MET antigen as described in Example 7.17, CHO cells expressing the mutated human c-MET antigen with murine membrane-distal epitopes as described in Example 7.17 and CHO cells expressing the mutated murine c-MET antigen with human membrane-distal epitopes as described in Example 7.17, respectively. The FACS staining was performed as described in Example 7.9. The bold lines represent cells incubated with periplasmic preparations containing the c-MET specific scFv antibodies. The filled histograms show the negative controls. The Buffer used for periplasmic preparations was used as negative control. For each c-MET specific scFv antibody the overlays of the histograms show specific binding of the construct to human c-MET and human c-MET with murine membrane-distal epitopes. No significant binding to cells positive for murine c-MET and to cells positive for the mutated murine c-MET with human membrane-distal epitopes, respectively, was detectable.

FIG. 17

FACS binding analysis of designated bispecific single chain constructs to CHO cells expressing human IGF-1R as described in Example 9.1, the human CD3+ T cell line HPB-ALL, CHO cells expressing macaque IGF-1R as described in Example 9.15 and the macaque T cell line 4119LnPx, respectively. The FACS staining was performed as described in Examples 9.13 and 9.16. The bold lines represent cells incubated with cell culture supernatant of transfected cells expressing the bispecific antibody constructs. The filled histograms show the negative controls. Supernatant of untransfected CHO cells was used as negative control. For each bispecific single chain construct the overlays of the histograms show specific binding of the construct to human and macaque IGF-1R and human and macaque CD3.

FIG. 18

FACS binding analysis of designated bispecific single chain constructs to CHO cells expressing the murine IGF-1R antigen as described in Example 9.3, CHO cells expressing the mutated human IGF-1R antigen with murine membrane-distal epitopes as described in Example 9.4 and CHO cells expressing the mutated murine IGF-1R antigen with human membrane-distal epitopes as described in Example 9.5, respectively. The FACS staining was performed as described in Example 9.13. The bold lines represent cells incubated with cell culture supernatant of transfected cells expressing the bispecific antibody constructs. The filled histograms show the negative controls. Supernatant of untransfected CHO cells was used as negative control. For each bispecific single chain construct the overlays of the histograms show specific binding of the construct to the mutated human IGF-1R antigen with murine membrane-distal epitopes but not to the mutated murine IGF-1R antigen with human membrane-distal epitopes and not to the murine IGF-1R antigen.

FIG. 19

The diagrams show results of chromium release assays measuring cytotoxic activity induced by designated IGF-1R specific single chain constructs redirected to the CHO cells expressing human IGF-1R as described in Example 9.1. Effector cells were used as indicated. The assays were performed as described in Example 9.14. The diagrams clearly demonstrate for each construct the potent recruitment of cytotoxic activity of human effector T cells against target cells positive for human IGF-1R.

FIG. 20

FACS binding analysis of designated bispecific single chain constructs to CHO cells expressing designated human/rat PSMA chimeras as described in Example 10.2.1. The FACS staining was performed as described in Example 10.2.2. The bold lines represent cells incubated with cell culture supernatant of transfected cells expressing the bispecific antibody constructs. The filled histograms show the negative controls. Supernatant of untransfected CHO cells was used as negative control. For each bispecific single chain construct the overlays of the histograms show specific binding of the construct to the chimeric constructs huPSMArat140-169, huPSMArat281-284, huPSMArat300-344, huPSMArat683-690 and huPSMArat716-750. Compared with the signals obtained for the other bispecific single chain construct there is a clear lack of binding for the bispecific single chain antibody construct PSMA-P7 HL×I2C HL to the chimeric PSMA construct huPSMArat598-617.

FIG. 21

The Figure shows binding signals obtained with periplasmic preparations of the scFv antibody of the PSMA specific binder of PSMA-D4 HL×I2C HL to 15-mer peptides spanning over the extracellular domain of human PSMA and overlapping with their neighboring peptides by 14 amino acids. Signals obtained for the peptides are plotted on the X-axis in order of the N-terminal peptides on the left to the C-terminal peptides on the right. Strength of ELISA signals using His detection is plotted on the Y-axis. The ELISA was performed as described in Example 10.3. A distinct maximum signal is detectable for the peptide spanning over the amino acids threonine 334 to threonine 339.

FIG. 22

The diagram shows results of a CytoTox-Glo™ cytotoxicity assay measuring cytotoxic activity of unstimulated human T cells induced by designated PSMA specific bispecific single chain constructs against CHO cells expressing human PSMA as described in Example 2.1. The assay was performed as described in Example X.4. The diagram clearly demonstrates the superior cytotoxic activity of PSMA bispecific single chain antibody PSMA-P7 HL×I2C HL directed at a membrane-proximal target epitope of human PSMA over PSMA bispecific single chain antibody PSMA-D4 HL×I2C HL directed at a membrane-distal target epitope of human PSMA.

TABLE LEGENDS

Table 1

All extracellular amino acids of human PSMA mismatching with the homologous rat PSMA amino acid sequence. Those mismatched extracellular human PSMA amino acids, whose alpha C-atoms have a distance of ≥60 Å from the alpha C-atom of the thirteenth extracellular human PSMA amino acid (i.e. the reference aa) as counted from the junction of transmembrane and extracellular region are marked in bold. The distances between alpha C-atoms of two amino acids within human PSMA were determined using the crystal structure of human PSMA (accession No 1Z8L; obtained from the RCSB pdb, protein data bank of the Research Collaboratory for Structural Bioinformatics) and the "measure distance mode" of the software "3D molecule viewer" (a component of Vector NTI® Suite 8.0, Informax Inc.). Numbering of amino acid positions refers to human PSMA and starts with the amino acid methionine encoded by the start codon of human PSMA. The reference aa is histidine at position 56.

Table 2

All extracellular amino acids of human FAPalpha mismatching with the homologous murine FAPalpha amino acid sequence. Those mismatched extracellular human FAPalpha amino acids, whose alpha C-atoms have a distance of ≥60 Å from the alpha C-atom of the thirteenth extracellular human FAPalpha amino acid (i.e. the reference aa) as counted from the junction of transmembrane and extracellular region are marked in bold. The distances between alpha C-atoms of two amino acids within human FAPalpha were determined using the crystal structure of human FAPalpha (Accession No 1Z68; obtained from the RCSB pdb, protein data bank of the Research Collaboratory for Structural Bioinformatics; http://www.rcsb.org/pdb) and the "measure distance mode" of the software "3D molecule viewer" (a component of Vector NTI Suite 8.0, Informax Inc.). Numbering of amino acid positions refers to human FAPalpha and starts with the amino acid methionine encoded by the start codon of human FAPalpha. The reference aa is methionine at position 39.

The present invention is additionally described by way of the following illustrative non-limiting examples that provide a better understanding of the present invention and of its many advantages.

EXAMPLES

1. Cytotxicity with Respect to the Distance of the Target Cell Epitopes Distance from the Target Cell Membrane 1.1. Generation of CHO Cells Expressing the Human EpCAM Antigen The sequence of the human EpCAM antigen ('NM_002354, *Homo sapiens* tumor-associated calcium signal transducer 1 (TACSTD1), mRNA, National Center for Biotechnology Information, http://www.ncbi.nlm.nih.gov/entrez) was used to obtain a synthetic molecule by gene synthesis according to standard protocols. The gene synthesis fragment was also designed as to contain a Kozak site for eukaryotic expression of the construct and restriction sites at the beginning and the end of the DNA. The introduced restriction sites XbaI at the 5' end and SalI at the 3' end were utilised in the following cloning procedures. The gene synthesis fragment was cloned via XbaI and SalI into a plasmid designated pEF-DHFR (pEF-DHFR is described in Raum et al. Cancer Immunol Immunother 50 (2001) 141-150). The aforementioned procedures were carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX.

1.2. Generation of CHO Cells Expressing EpCAM-hNG2 Fusion Proteins

The coding sequences of EpCAM-hNG2 fusion proteins EpCAM-D1-hNG2 (SEQ ID Nos 189 and 190), EpCAM-D3-hNG2 (SEQ ID Nos 191 and 192), EpCAM-D1D3-hNG2 (SEQ ID Nos 193 and 194), EpCAM-D1D2-hNG2 (SEQ ID Nos 195 and 196) and EpCAM-hNG2 (SEQ ID Nos 197 and 198) were obtained by gene synthesis according to standard protocols. The gene synthesis fragment was designed as to contain first the coding sequence of an immunoglobulin leader peptide followed subsequently by human EpCAM, the respective extracellular part of human NG2 and the transmembrane and cytoplasmic domain of the human NG2 (Pluschke (1996) PNAS 93: 9710-9715). The different components were connected by short peptide linkers. The gene synthesis fragments were also designed as to introduce restriction sites at the 5' end (Eco RI) and at the 3' end (Sal I) for cloning into the mammalian cell expression vector pEF-DHFR (pEF-DHFR is described in Raum et al. Cancer Immunol Immunother 50 (2001) 141-150). The aforementioned procedures were carried out according to standard protocols (Sambrook, Molecular Cloning; A Laboratory Manual, 3rd edition, Cold Spring Harbour Laboratory Press, Cold Spring Harbour, N.Y. (2001)). For each EpCAM-hNG2 fusion protein a clone with sequence-verified nucleotide sequence was transfected into DHFR deficient CHO cells for eukaryotic expression. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX.

1.3. Generation of the EpCAM and CD3 Bispecific Single Antibody 5-10×I2C

The bispecific single chain antibody 5-10×I2C comprising the scFv binding domain 5-10 (in VL-VH arrangement) directed at human EpCAM (Brischwein (2007) J Immunother 30: 798-807) and the scFv binding domain I2C (in VL-VH arrangement) directed at CD3epsilon on human T cells was obtained by gene synthesis. The gene synthesis fragment was designed as to contain first a Kozak site for eukaryotic expression of the construct, followed by a 19 amino acid immunoglobulin leader peptide, followed in frame by the coding sequence of the bispecific single chain antibody 5-10×I2C, followed in frame by the coding sequence of a 6 histidine tag and a stop codon (the cDNA and amino acid sequence of the construct is listed under SEQ ID Nos 199 and 200). The gene synthesis fragment was also designed as to introduce suitable restriction sites at the beginning (EcoRI) and at the end of the fragment (Sal I) for cloning of the gene synthesis fragment into the mammalian cell expression vector pEF-DHFR (pEF-DHFR is described in Raum et al. Cancer Immunol Immunother 50 (2001) 141-150). The aforementioned procedures were carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX. After two passages of stationary culture cell culture supernatant was collected and used in the subsequent experiments.

1.4. Flowcytometry of CHO Cells Transfected with Different EpCAM-hNG2 Fusion Proteins The presence of the EpCAM-epitope of bispecific single chain antibody 5-10×I2C on the CHO cells transfected with native EpCAM and the EpCAM-hNG2 fusion proteins EpCAM-D1-hNG2, EpCAM-D3-hNG2, EpCAM-D1D3-hNG2, EpCAM-D1D2-hNG2 and EpCAM-hNG2, respectively, was confirmed by flow cytometry with the murine parental IgG1 antibody Mab 5-10 as described (Brischwein (2007) J Immunother 30: 798-807). The result is shown in FIG. 1.

Figure 2:
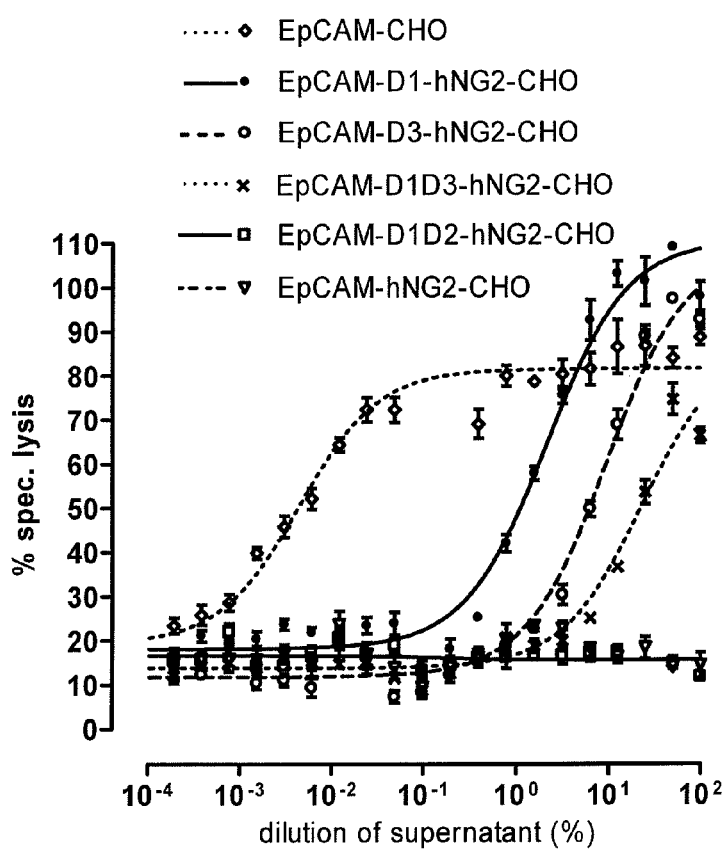

1.5. T Cell Cytotoxicity Redirected by bscAb 5-10×I2C Against CHO Cells Transfected with Different EpCAM-hNG2 Fusion Proteins T cell cytotoxicity redirected by bscAb 5-10×I2C against CHO cells transfected with different EpCAM-hNG2 fusion proteins was measured in a chromium 51 ($^{51}$Cr) release in vitro cytotoxicity assay. As source of effector T cells stimulated human CD4/CD56 depleted PBMC were used. Stimulated human PBMC were obtained as follows: A Petri dish (145 mm diameter, Greiner bio-one GmbH, Kremsmünster) was coated with a commercially available anti-CD3 specific antibody (e.g. OKT3, Orthoclone) in a final concentration of 1 µg/ml for 1 hour at 37° C. Unbound protein was removed by one washing step with PBS. The fresh PBMC were isolated from peripheral blood (30-50 ml human blood) by Ficoll gradient centrifugation according to standard protocols. 3-5× $10^7$ PBMC were added to the precoated petri dish in 120 ml of RPMI 1640 with stabilized glutamine/10% FCS/IL-2 20 U/ml (Proleukin, Chiron) and stimulated for 2 days. On the third day the cells were collected and washed once with RPMI 1640. IL-2 was added to a final concentration of 20 U/ml and the cells were cultured again for one day in the same cell culture medium as above. By depletion of CD4+ T cells and CD56+ NK cells according to standard protocols CD8+ cytotoxic T lymphocytes (CTLs) were enriched. Target cells were washed twice with PBS and labelled with 11.1 MBq $^{51}$Cr in a final volume of 100 µl RPMI with 50% FCS for 60 minutes at 37° C. Subsequently the labelled target cells were washed 3 times with 5 ml RPMI and then used in the cytotoxicity assay. The assay was performed in a 96 well plate in a total volume of 250 µl supplemented RPMI (as above) with an E:T ratio of 10:1. BscAb 5-10×I2C was added as culture supernatant from transfected CHO cells at different dilutions. The assay time was 18 hours. Cytotoxicity was measured as relative values of released chromium related to the difference of maximum lysis (addition of Triton-X) and spontaneous lysis (without effector cells). All measurements were carried out in quadruplicates. Measurement of released chromium activity was performed with a Wizard® 3" gammacounter (Perkin Elmer Life Sciences GmbH, Koln, Germany). Analysis of the experimental data was performed with Prism 4 for Windows® (version 4.02, GraphPad Software Inc., San Diego, Calif., USA). Sigmoidal dose response curves typically had $R^2$ values >0.90 as determined by the software. As shown in FIG. 2 the T cell cytotoxicity redirected by bscAb 5-10×I2C against the indicated target cells critically depends on the varying distance of the target EpCAM epitope of bsc 5-10×I2C in the different EpCAM-hNG2 model antigens from the target cell membrane. The descending order of T cell cytotoxicity with increasing membrane distance of the target epitope as given in parentheses is EpCAM-CHO (positive control)>EpCAM-D1-hNG2 (640 aa)>EpCAM-D3-hNG2 (679 aa)>EpCAM-D1D3-hNG2 (871 aa). There was no cytotoxic activity detectable against CHO cells expressing EpCAM-D1 D2-hNG2 (1511 aa) or EpCAM-hNG2 (2190 aa).

2. Generation of Bispecific Single Chain Antibodies Directed at Membrane-proximal Target Epitopes of Human PSMA 2.1 Generation of CHO Cells Expressing Human PSMA The coding sequence of human PSMA as published in GenBank (Accession number NM_004476) is obtained by gene synthesis according to standard protocols. The gene synthesis fragment is designed as to contain first a Kozak site for eukaryotic expression of the construct followed by the coding sequence of the human PSMA protein and a stop codon (the cDNA and amino acid sequence of the construct is listed under SEQ ID Nos 201 and 202). The gene synthesis fragment is also designed as to introduce restriction sites at the beginning and at the end of the fragment. The introduced restriction sites, XbaI at the 5' end and SalI at the 3' end, are utilized in the following cloning procedures. The gene synthesis fragment is cloned via XbaI and SalI into a plasmid designated pEF-DHFR (pEF-DHFR is described in Raum et al. Cancer Immunol Immunother 50 (2001) 141-150) following standard protocols. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

2.2 Generation of a Soluble Human PSMA Fusion Protein

The coding sequence of human PSMA as described in Example 2.1 and the coding sequence of murine Lag3 as published in GenBank (Accession number NM_008479) are used for the construction of an artificial cDNA sequence encoding a soluble fusion protein of human PSMA and murine Lag3. To generate a construct for expression of the soluble human PSMA fusion protein a cDNA fragment is obtained by gene synthesis according to standard protocols (the cDNA and amino acid sequence of the construct is listed under SEQ ID Nos 203 and 204). The gene synthesis fragment is designed as to contain first a Kozak site for eukaryotic expression of the construct followed by the coding sequence of the murine Lag3 protein from amino acid 1 to 441 corresponding to the signal peptide and extracellular domains of murine Lag3, followed in frame by the coding sequence of an artificial $Ser_1$-$Gly_4$-$Ser_1$-linker, followed in frame by the coding sequence of the human PSMA protein from amino acid 44 to 750 corresponding to the extracellular domains of human PSMA, followed in frame by the coding sequence of an artificial $Ser_1$-$Gly_1$-linker, followed in frame by the coding sequence of a 6 histidine tag and a stop codon. The gene synthesis fragment is also designed as to introduce restriction sites at the beginning and at the end of the fragment. The introduced restriction sites, XbaI at the 5' end and SalI at the 3' end, are utilized in the following cloning procedures. The gene synthesis fragment is cloned via XbaI and SalI into a plasmid designated pEF-DHFR (pEF-DHFR is described in Raum et al. Cancer Immunol Immunother 50 (2001) 141-150) following standard protocols. The aforementioned procedures are all carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX. After two passages of stationary culture the cells are grown in roller bottles with nucleoside-free HyQ PF CHO liquid soy medium (with 4.0 mM L-Glutamine with 0.1% Pluronic F—68; HyClone) for 7 days before harvest. The cells are removed by centrifugation and the supernatant containing the expressed protein is stored at −20° C. Alternatively a clone of the expression plasmid with sequence-verified nucleotide sequence is used for transfection and protein expression in the FreeStyle 293 Expression System (Invitrogen GmbH, Karlsruhe, Germany) according to the manufacturer's protocol. Supernatant containing the expressed protein is obtained, cells are removed by centrifugation and the supernatant is stored at −20° C.

Purification of the soluble human PSMA fusion protein is performed as follows: Äkta® Explorer System (GE Health Systems) and Unicorn® Software are used for chromatography. Immobilized metal affinity chromatography ("IMAC") is performed using a Fractogel EMD Chelate® (Merck) which is loaded with $ZnCl_2$ according to the protocol provided by the manufacturer. The column is equilibrated with buffer A (20 mM sodium phosphate buffer pH 7.2, 0.1 M NaCl) and the cell culture supernatant (500 ml) is applied to the column (10 ml) at a flow rate of 3 ml/min. The column is washed with buffer A to remove unbound sample. Bound protein is eluted using a two step gradient of buffer B (20 mM sodium phosphate buffer pH 7.2, 0.1 M NaCl, 0.5 M Imidazole) according to the following procedure:

Step 1: 20% Buffer B in 6 Column Volumes
Step 2: 100% Buffer B in 6 Column Volumes Eluted protein fractions from step 2 are pooled for further purification. All chemicals are of research grade and purchased from Sigma (Deisenhofen) or Merck (Darmstadt).

Gel filtration chromatography is performed on a HiLoad 16/60 Superdex 200 prep grade column (GE/Amersham) equilibrated with Equi-buffer (25 mM Citrate, 200 mM Lysine, 5% Glycerol, pH 7.2). Eluted protein samples (flow rate 1 ml/min) are subjected to standard SDS-PAGE and Western Blot for detection. Prior to purification, the column is calibrated for molecular weight determination (molecular weight marker kit, Sigma MW GF-200). Protein concentrations are determined using OD280 nm.

2.3 Generation of CHO Cells Expressing Rat PSMA

The sequence of rat PSMA (NM_057185, *Rattus norvegicus* folate hydrolase (Folh1), mRNA, National Center for Biotechnology Information, http://www.ncbi.nlm.nih.gov/entrez) is used to obtain a synthetic cDNA molecule by gene synthesis according to standard protocols. The gene synthesis fragment is designed as to contain first a Kozak site for eukaryotic expression of the construct followed by the complete coding sequence of the rat PSMA antigen, followed in frame by the coding sequence of a FLAG-tag and a stop codon (the cDNA and amino acid sequence of the construct is listed under SEQ ID Nos 205 and 206). The gene synthesis fragment is also designed as to introduce restriction sites at the 5' end (EcoRI) and at the 3' end (SalI) of the cDNA fragment for cloning into the mammalian cell expression vector pEF-DHFR (pEF-DHFR is described in Raum et al. Cancer Immunol Immunother 50 (2001) 141-150). The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

2.4 Generation of CHO Cells Expressing a Mutated Human PSMA Antigen with Rat Membrane-distal Epitopes The coding sequence of a mutated human PSMA antigen with rat membrane-distal epitopes is obtained by gene synthesis according to standard protocols The gene synthesis fragment is designed as to contain first a Kozak site for eukaryotic expression of the construct followed by the complete coding sequence of the human PSMA antigen mutated at 12 specific amino acid positions as explained below, followed in frame by the coding sequence of a FLAG tag and a stop codon (the cDNA and amino acid sequence of the construct is listed under SEQ ID Nos 207 and 208). All extracellular amino acids of human PSMA mismatching with the homologous rat sequence, whose alpha C-atoms have a distance of $\geq 60$ Å from the alpha C-atom of the thirteenth extracellular amino acid (i.e. the reference aa) as counted from the junction of transmembrane and extracellular region, are mutated to the homologous mismatched rat amino acid. This applies to the 12 amino acids that are listed in table Table 1 and marked in bold. The homologous mismatched amino acids between human and rat PSMA are identified by sequence alignment as shown in FIG. 3. The gene synthesis fragment is also designed as to introduce restriction sites at the 5' end (Xba I) and at the 3' end (Sal I) of the cDNA fragment for cloning into the mammalian cell expression vector pEF-DHFR (pEF-DHFR is described in Raum et al. Cancer Immunol Immunother 50 (2001) 141-150). The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

2.5 Generation of CHO Cells Expressing a Mutated Rat PSMA Antigen with Human Membrane-distal Epitopes The coding sequence of a mutated rat PSMA antigen with human membrane-distal epitopes is obtained by gene synthesis according to standard protocols The gene synthesis fragment is designed as to contain first a Kozak site for eukaryotic expression of the construct followed by the complete coding sequence of the rat PSMA antigen mutated at the same 12 specific extracellular amino acid positions as identified in the foregoing Example 2.4 to the respective homologous human amino acid, followed in frame by the coding sequence of a FLAG tag and a stop codon (the cDNA and amino acid sequence of the construct is listed under SEQ ID Nos 209 and 210). The gene synthesis fragment is also designed as to introduce restriction sites at the 5' end (EcoRI I) and at the 3' end (Sal I) of the cDNA fragment for cloning into the mammalian cell expression vector pEF-DHFR (pEF-DHFR is described in Raum et al. Cancer Immunol Immunother 50 (2001) 141-150). The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

2.6 Immunization of Mice Using a Soluble Human PSMA Fusion Protein

Twelve weeks old F1 mice from BALB/c×C57BL/6 crossings are immunized with the soluble human PSMA fusion protein as described in Example 2.2 To this end for each animal 40 µg of the soluble human PSMA fusion protein are mixed with 10 nmol of a thioate-modified CpG-Oligonucleotide (5'-tccatgacgttcctgatgct-3') in 300 µl PBS and are injected intraperitoneally. Mice receive booster immunizations after 21, 42 and optionally 63 days in the same way. Ten days after the first booster immunization, blood samples are taken and antibody serum titers against human PSMA are tested by flow cytometry according to standard protocols. To this end 200,000 cells of the human PSMA transfected CHO cells as described in Example 2.1 are incubated for 30 min on ice with 50 µl of serum of the immunized animals diluted 1:1000 in PBS with 2% FCS. The cells are washed twice in PBS with 2% FCS and binding of serum antibodies is detected with an mouse Fc gamma-specific antibody (Dianova) conjugated to phycoerythrin, diluted 1:100 in PBS with 2% FCS. Serum of the animals obtained prior to immunization is used as a negative control. Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

Animals demonstrating significant serum reactivity against human PSMA as determined by the FACS analysis are used in the subsequent experiment.

2.7 Generation of an Immune Murine Antibody scFv Library: Construction of a Combinatorial Antibody Library and Phage Display Three days after the last booster immunization spleen cells of reactive animals are harvested for the preparation of total RNA according to standard protocols.

A library of murine immunoglobulin (Ig) light chain (kappa) variable region (VK) and Ig heavy chain variable region (VH) DNA-fragments is constructed by RT-PCR on murine spleen RNA using VK- and VH specific primers. cDNA is synthesized according to standard protocols.

The primers are designed in a way to give rise to a 5'-XhoI and a 3'-BstEII recognition site for the amplified heavy chain V-fragments and to a 5'-SacI and a 3'-SpeI recognition site for amplified VK DNA fragments.

For the PCR-amplification of the VH DNA-fragments eight different 5'-VH-family specific primers (MVH1(GC) AG GTG CAG CTC GAG GAG TCA GGA CCT SEQ ID NO: 211; MVH2 GAG GTC CAG CTC GAG CAG TCT GGA CCT SEQ ID NO: 212; MVH3 CAG GTC CAA CTC GAG CAG CCT GGG GCT SEQ ID NO: 213; MVH4 GAG GTT CAG CTC GAG CAG TCT GGG GCA SEQ ID NO: 214; MVH5 GA(AG) GTG AAG CTC GAG GAG TCT GGA GGA SEQ ID NO: 215; MVH6 GAG GTG AAG CTT CTC GAG TCT GGA GGT SEQ ID NO: 216; MVH7 GAA GTG AAG CTC GAG GAG TCT GGG GGA SEQ ID NO: 217; MVH8 GAG GTT CAG CTC GAG CAG TCT GGA GCT SEQ ID NO: 218) are each combined with one 3'-VH primer (3'MuVHBstEII tga gga gac ggt gac cgt ggt ccc ttg gcc cca g SEQ ID NO: 219); for the PCR amplification of the VK-chain fragments seven different 5'-VK-family specific primers (MUVK1 CCA GTT CCG AGC TCG TTG TGA CTC AGG AAT CT SEQ ID NO: 220; MUVK2 CCA GTT CCG AGC TCG TGT TGA CGC AGC CGC CC SEQ ID NO: 221; MUVK3 CCA GTT CCG AGC TCG TGC TCA CCC AGT CTC CA SEQ ID NO: 222; MUVK4 CCA GTT CCG AGC TCC AGA TGA CCC AGT CTC CA SEQ ID NO: 223; MUVK5 CCA GAT GTG AGC TCG TGA TGA CCC AGA CTC CA SEQ ID NO: 224; MUVK6 CCA GAT GTG AGC TCG TCA TGA CCC AGT CTC CA SEQ ID NO: 225; MUVK7 CCA GTT CCG AGC TCG TGA TGA CAC AGT CTC CA SEQ ID NO: 226) are each combined with one 3'-VK primer (3'MuVkHindIII/BsiW1 tgg tgc act agt cgt acg ttt gat ctc aag ctt ggt ccc SEQ ID NO: 227).

The following PCR program is used for amplification: denaturation at 94° C. for 20 sec; primer annealing at 52° C. for 50 sec and primer extension at 72° C. for 60 sec and 40 cycles, followed by a 10 min final extension at 72° C.

450 ng of the kappa light chain fragments (SacI-SpeI digested) are ligated with 1400 ng of the phagemid pComb3H5Bhis (SacI-SpeI digested; large fragment). The resulting combinatorial antibody library is then transformed into 300 µl of electrocompetent *Escherichia coli* XL1 Blue cells by electroporation (2.5 kV, 0.2 cm gap cuvette, 25 µFD, 200 Ohm, Biorad gene-pulser) resulting in a library size of more than $10^7$ independent clones. After one hour of phenotype expression, positive transformants are selected for carbenicillin resistance encoded by the pComb3H5BHis vector in 100 ml of liquid super broth (SB)-culture over night. Cells are then harvested by centrifugation and plasmid preparation is carried out using a commercially available plasmid preparation kit (Qiagen).

2800 ng of this plasmid-DNA containing the VK-library (XhoI-BstEII digested; large fragment) are ligated with 900 ng of the heavy chain V-fragments (XhoI-BstEII digested) and again transformed into two 300 µl aliquots of electrocompetent *E. coli* XL1 Blue cells by electroporation (2.5 kV, 0.2 cm gap cuvette, 25 µFD, 200 Ohm) resulting in a total VH-VK scFv (single chain variable fragment) library size of more than $10^7$ independent clones.

After phenotype expression and slow adaptation to carbenicillin, the *E. coli* cells containing the antibody library are transferred into SB-Carbenicillin (SB with 50 µg/mL carbenicillin) selection medium. The *E. coli* cells containing the antibody library are then infected with an infectious dose of $10^{12}$ particles of helper phage VCSM13 resulting in the production and secretion of filamentous M13 phage, wherein each phage particle contains single stranded pComb3H5BHis-DNA encoding a murine scFv-fragment and displays the corresponding scFv-protein as a translational fusion to phage coat protein III. This pool of phages displaying the antibody library is later used for the selection of antigen binding entities.

2.8 Phage Display Based Selection of Membrane-proximal Target Binders on CHO Cells Expressing the Mutated Human Psma Antigen with Rat Membrane-distal Epitopes The phage library carrying the cloned scFv-repertoire is harvested from the respective culture supernatant by PEG8000/NaCl precipitation and centrifugation. Approximately $10^{11}$ to $10^{12}$ scFv phage particles are resuspended in 0.4 ml of PBS/0.1% BSA and incubated with $10^5$ to $10^7$ CHO cells expressing the mutated human PSMA antigen with rat membrane-distal epitopes as described in example 2.4 for 1 hour on ice under slow agitation. These CHO cells are grown beforehand, harvested by centrifugation, washed in PBS and resuspended in PBS/1% FCS (containing Na Azide). scFv phage which do not specifically bind to the CHO cells are eliminated by up to five washing steps with PBS/1% FCS (containing Na Azide). After washing, binding entities are eluted from the cells by resuspending the cells in HCl-glycine pH 2.2 (10 min incubation with subsequent vortexing) and after neutralization with 2 M Tris pH 12, the eluate is used for infection of a fresh uninfected *E. coli* XL1 Blue culture (OD600>0.5). The *E. coli* culture containing *E. coli* cells successfully transduced with a phagemid copy, encoding a murine scFv-fragment, are again selected for carbenicillin resistance and subsequently infected with VCMS13 helper phage to start the second round of antibody display and in vitro selection. Typically a total of 4 to 5 rounds of selections are carried out.

2.9 Screening for Membrane-proximal Target Binders on CHO Cells Expressing the Human Psma Antigen, the Rat PSMA Antigen and the Mutated Rat PSMA Antigen with Human Membrane-distal Epitopes Plasmid DNA corresponding to 4 and 5 rounds of panning is isolated from *E. coli* cultures after selection. For the production of soluble scFv-protein, VH-VL-DNA fragments are excised from the plasmids (XhoI-SpeI). These fragments are cloned via the same restriction sites in the plasmid pComb3H5BFlag/His differing from the original pComb3H5BHis in that the expression construct (e.g. scFv) includes a Flag-tag (TGDYKDDDDK) between the scFv and the His6-tag and the additional phage proteins are deleted. After ligation, each pool (different rounds of panning) of plasmid DNA is transformed into 100 µl heat shock competent *E. coli* TG1 or XLI blue and plated onto carbenicillin LB-agar. Single colonies are picked into 100 µl of LB carb (LB with 50 µg/ml carbenicillin).

After induction with 1 mM IPTG *E. coli* transformed with pComb3H5BFlag/His containing a VL- and VH-segment produce soluble scFv in sufficient amounts. Due to a suitable signal sequence, the scFv is exported into the periplasma where it folds into a functional conformation.

Single *E. coli* bacterial colonies from the transformation plates are picked for periplasmic small scale preparations and grown in SB-medium (e.g. 10 ml) supplemented with 20 mM $MgCl_2$ and carbenicillin 50 µg/ml (and re-dissolved in PBS (e.g. 1 ml) after harvesting. A temperature shock is applied by four rounds of freezing at −70° C. and thawing at 37° C. whereby the outer membrane of the bacteria is destroyed and the soluble periplasmic proteins including the scFvs are released into the supernatant. After elimination of intact cells and cell-debris by centrifugation, the supernatant containing the murine anti-human PSMA-scFvs is collected and used for further examination.

Screening of the isolated scFvs for membrane-proximal target binders is performed by flow cytometry on CHO cells expressing the human PSMA antigen as described in Example 2.1, the rat PSMA antigen as described in Example 2.3 and the mutated rat PSMA antigen with human membrane-distal epitopes as described in Example 2.5. For flow cytometry $2.5 \times 10^5$ cells of the respective cell lines are incubated with 50 µl supernatant. The binding of the constructs is detected with an anti-His antibody (Penta-His Antibody, BSA free, Qiagen GmbH, Hilden, FRG) at 2 µg/ml in 50 µl PBS with 2% FCS. As a second step reagent a R-Phycoerythrin-conjugated affinity purified F(ab')2 fragment, goat anti-mouse IgG (Fc-gamma fragment specific), diluted 1:100 in 50 μl PBS with 2% FCS (Dianova, Hamburg, FRG) is used. The samples are measured on a FACSscan (BD biosciences, Heidelberg, FRG).

Only constructs which show binding to CHO cells expressing the human PSMA antigen and do not show binding to CHO cells expressing the rat PSMA antigen and also do not show binding to CHO cells expressing the mutated rat PSMA antigen with human membrane-distal epitopes are selected for further use.

2.10 Generation of Human/Humanized Equivalents of Non-human scFvs to Membrane-proximal Target Epitopes of Human PSMA The VH region of a murine anti-PSMA scFv to a membrane-proximal target epitope of human PSMA is aligned against human antibody germline amino acid sequences. The human antibody germline VH sequence is chosen which has the closest homology to the non-human VH and a direct alignment of the two amino acid sequences is performed. There are a number of framework residues of the non-human VH that differ from the human VH framework regions ("different framework positions"). Some of these residues may contribute to the binding and activity of the antibody to its target.

To construct a library that contains the murine CDRs and at every framework position that differs from the chosen human VH sequence both possible residues (the human and the maternal murine amino acid residue), degenerated oligonucleotides are synthesized. These oligonucleotides incorporate at the differing positions the human residue with a probability of 75% and the murine residue with a probability of 25%. For one human VH e.g. six of these oligonucleotides have to be synthesized that overlap in a terminal stretch of approximately 20 nucleotides. To this end every second primer is an antisense primer. Restriction sites within the oligonucleotides needed for later cloning are deleted.

These primers may have a length of 60 to 90 nucleotides, depending on the number of primers that are needed to span over the whole V sequence.

These e.g. six primers are mixed in equal amounts (e.g. 1 μl of each primer (primer stocks 20 to 100 μM) to a 20 μl PCR reaction) and added to a PCR mix consisting of PCR buffer, nucleotides and Taq polymerase. This mix is incubated at 94° C. for 3 minutes, 65° C. for 1 minute, 62° C. for 1 minute, 59° C. for 1 minute, 56° C. for 1 minute, 52° C. for 1 minute, 50° C. for 1 minute and at 72° C. for 10 minutes in a PCR cycler. Subsequently the product is run in an agarose gel electrophoresis and the product of a size from 200 to 400 base pairs isolated from the gel according to standard methods.

This PCR product is then used as a template for a standard PCR reaction using primers that incorporate suitable N-terminal and C-terminal cloning restriction sites. The DNA fragment of the correct size (for a VH approximately 350 nucleotides) is isolated by agarose gel electrophoresis according to standard methods. In this way sufficient VH DNA fragment is amplified. This VH fragment is now a pool of VH fragments that have each one a different amount of human and murine residues at the respective differing framework positions (pool of humanized VH). The same procedure is performed for the VL region of the murine anti-PSMA scFv to a membrane-proximal target epitope of human PSMA (pool of humanized VL).

The pool of humanized VH is then combined with the pool of humanized VL in the phage display vector pComb3H5Bhis to form a library of functional scFvs from which—after display on filamentous phage—anti-PSMA binders to membrane-proximal target epitopes of human PSMA are selected, screened, identified and confirmed as described above for the parental non-human (murine) anti-PSMA scFv. Single clones are then analyzed for favorable properties and amino acid sequence. Those scFvs, which are closest in amino acid sequence homology to human germline V-segments, are preferred.

Human/humanized anti-PSMA scFvs to membrane-proximal target epitopes of human PSMA are converted into recombinant bispecific single chain antibodies and further characterized as follows.

2.11 Generation of I2C-based Bispecific Single Chain Antibodies Directed at Membrane-proximal Target Epitopes of Human PSMA Anti-PSMA scFvs to membrane-proximal target epitopes of human PSMA with favorable properties and amino acid sequence are converted into recombinant bispecific single chain antibodies by joining them via a $Gly_4Ser_1$-linker with the CD3 specific scFv 120 (SEQ ID NO: 185) to result in constructs with the domain arrangement $VH_{PSMA}$-$(Gly_4Ser_1)_3$-$VL_{PSMA}$-$Ser_1Gly_4Ser_1$-$VH_{CD3}$-$(Gly_4Ser_1)_3$-$VL_{CD3}$. Alternatively further constructs with different domain arrangements can be generated according to standard protocols. For expression in CHO cells the coding sequences of (i) an N-terminal immunoglobulin heavy chain leader comprising a start codon embedded within a Kozak consensus sequence and (ii) a C-terminal His6-tag followed by a stop codon are both attached in frame to the nucleotide sequence encoding the bispecific single chain antibodies prior to insertion of the resulting DNA-fragment as obtained by gene synthesis into the multiple cloning site of the expression vector pEF-DHFR (Raum et al. Cancer Immunol Immunother 50 (2001) 141-150). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

2.12 Expression and Purification of Bispecific Single Chain Antibody Molecules Directed at Membrane-proximal Target Epitopes of Human PSMA Bispecific single chain antibody molecules are expressed in Chinese hamster ovary cells (CHO). Eukaryotic protein expression in DHFR deficient CHO cells is performed as described by Kaufmann R. J. (1990) Methods Enzymol. 185, 537-566. Gene amplification of the constructs is induced by addition of increasing concentrations of MTX up to final concentrations of 20 nM MTX. After two passages of stationary culture cell culture supernatant is collected and used in the subsequent experiments. To generate supernatant for purification after two passages of stationary culture the cells are grown in roller bottles with nucleoside-free HyQ PF CHO liquid soy medium (with 4.0 mM L-Glutamine with 0.1% Pluronic F-68; HyClone) for 7 days before harvest. The cells are removed by centrifugation and the supernatant containing the expressed protein is stored at −20° C. Alternatively, constructs are transiently expressed in HEK 293 cells. Transfection is performed with 293fectin reagent (Invitrogen, #12347-019) according to the manufacturer's protocol. Furthermore the constructs are alternatively expressed in transiently transfected DHFR deficient CHO cells using for example FuGENE® HD Transfection Reagent (Roche Diagnostics GmbH, Cat. No. 04709691001) according to the manufacturer's protocol.

Äkta® Explorer System (GE Health Systems) and Unicorn® Software are used for chromatography. Immobilized metal affinity chromatography ("IMAC") is performed using a Fractogel EMD Chelate® (Merck) which is loaded with $ZnCl_2$ according to the protocol provided by the manufacturer. The column is equilibrated with buffer A (20 mM sodium phosphate buffer pH 7.2, 0.1 M NaCl) and the cell culture supernatant (500 ml) is applied to the column (10 ml) at a flow rate of 3 ml/min. The column is washed with buffer A to remove unbound sample. Bound protein is eluted using a two step gradient of buffer B (20 mM sodium phosphate buffer pH 7.2, 0.1 M NaCl, 0.5 M Imidazole) according to the following procedure:
Step 1: 20% buffer B in 6 column volumes
Step 2: 100% buffer B in 6 column volumes
Eluted protein fractions from step 2 are pooled for further purification. All chemicals are of research grade and purchased from Sigma (Deisenhofen) or Merck (Darmstadt).

Gel filtration chromatography is performed on a HiLoad 16/60 Superdex 200 prep grade column (GE/Amersham) equilibrated with Equi-buffer (25 mM Citrate, 200 mM Lysine, 5% Glycerol, pH 7.2). Eluted protein samples (flow rate 1 ml/min) are subjected to standard SDS-PAGE and Western Blot for detection. Prior to purification, the column is calibrated for molecular weight determination (molecular weight marker kit, Sigma MW GF-200). Protein concentrations are determined using OD280 nm.

Purified bispecific single chain antibody protein is analyzed in SDS PAGE under reducing conditions performed with pre-cast 4-12% Bis Tris gels (Invitrogen). Sample preparation and application are performed according to the protocol provided by the manufacturer. The molecular weight is determined with MultiMark protein standard (Invitrogen). The gel is stained with colloidal Coomassie (Invitrogen protocol). The purity of the isolated protein is typically >95% as determined by SDS-PAGE.

The bispecific single chain antibody has a molecular weight of about 52 kDa under native conditions as determined by gel filtration in PBS.

Western Blot is performed using an Optitran® BA-S83 membrane and the Invitrogen Blot Module according to the protocol provided by the manufacturer. The antibody used is directed against the His Tag (Penta His, Qiagen) and a Goat-anti-mouse Ig labeled with alkaline phosphatase (AP) (Sigma) is used as second step reagent, and BCIP/NBT (Sigma) as substrate. A band detected at 52 kD corresponds to purified bispecific single chain antibodies.

2.13 Flow Cytometric Binding Analysis of Bispecific Antibodies Directed at Membrane-proximal Target Epitopes of Human PSMA In order to test the functionality of bispecific antibody constructs regarding the capability to bind to CD3 and to membrane-proximal target epitopes of human PSMA, respectively, a FACS analysis is performed. For this purpose CHO cells transfected with human PSMA as described in Example 2.1 and the human CD3 positive T cell leukemia cell line HPB-ALL (DSMZ, Braunschweig, ACC483) are used. For confirmation of binding to membrane-proximal target epitopes of human PSMA—in addition—CHO cells expressing the rat PSMA antigen as described in Example 2.3 and CHO cells expressing the mutated rat PSMA antigen with human membrane-distal epitopes as described in Example 2.5 are used. 200,000 cells of the respective cell lines are incubated for 30 min on ice with 50 µl of cell culture supernatant of transfected cells expressing the bispecific antibody constructs. The cells are washed twice in PBS with 2% FCS and binding of the construct is detected with a murine Penta His antibody (Qiagen; diluted 1:20 in 50 µl PBS with 2% FCS). After washing, bound anti His antibodies are detected with an Fc gamma-specific antibody (Dianova) conjugated to phycoerythrin, diluted 1:100 in PBS with 2% FCS. Supernatant of untransfected cells is used as a negative control.

Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

Only those constructs that show bispecific binding to human CD3 as well as to human PSMA and neither bind to the rat PSMA antigen nor to the mutated rat PSMA antigen with human membrane-distal epitopes are selected for further use.

2.14 Bioactivity of Bispecific Antibodies Directed at Membrane-proximal Target Epitopes of Human PSMA Bioactivity of generated bispecific single chain antibodies is analyzed by chromium 51 ($^{51}Cr$) release in vitro cytotoxicity assays using the CHO cells transfected with human PSMA described in Example 2.1. As effector cells stimulated human CD4/CD56 depleted PBMC are used.

Stimulated Human PBMC are obtained as follows:

A Petri dish (145 mm diameter, Greiner bio-one GmbH, Kremsmünster) is coated with a commercially available anti-CD3 specific antibody (e.g. OKT3, Orthoclone) in a final concentration of 1 µg/ml for 1 hour at 37° C. Unbound protein is removed by one washing step with PBS. The fresh PBMC are isolated from peripheral blood (30-50 ml human blood) by Ficoll gradient centrifugation according to standard protocols. $3-5\times10^7$ PBMC are added to the precoated petri dish in 120 ml of RPMI 1640 with stabilized glutamine/10% FCS/IL-2 20 U/ml (Proleukin, Chiron) and stimulated for 2 days. On the third day the cells are collected and washed once with RPMI 1640. IL 2 is added to a final concentration of 20 U/ml and the cells are cultivated again for one day in the same cell culture medium as above.

By depletion of CD4+ T cells and CD56+ NK cells according to standard protocols CD8+ cytotoxic T lymphocytes (CTLs) are enriched.

Target cells are washed twice with PBS and labeled with 11.1 MBq $^{51}Cr$ in a final volume of 100 µl RPMI with 50% FCS for 60 minutes at 37° C. Subsequently the labeled target cells are washed 3 times with 5 ml RPMI and then used in the cytotoxicity assay. The assay is performed in a 96 well plate in a total volume of 250 µl supplemented RPMI (as above) with an E:T ratio of 10:1. 1 µg/ml of purified bispecific single chain antibody molecule and 20 threefold dilutions thereof are applied. The assay time is 18 hours. Cytotoxicity is measured as relative values of released chromium in the supernatant related to the difference of maximum lysis (addition of Triton-X) and spontaneous lysis (without effector cells). All measurements are done in quadruplicates. Measurement of chromium activity in the supernatants is performed with a Wizard® 3" gammacounter (Perkin Elmer Life Sciences GmbH, Koln, Germany). Analysis of the experimental data is performed with Prism 4 for Windows® (version 4.02, Graph-Pad Software Inc., San Diego, Calif., USA). Sigmoidal dose response curves typically have $R^2$ values >0.90 as determined by the software. EC50 values calculated by the analysis program are used for comparison of bioactivity.

Only those constructs showing potent recruitment of cytotoxic activity of effector T cells against target cells positive for PSMA are selected for further use.

2.15 Generation of CHO Cells Expressing Macaque PSMA

The cDNA sequence of macaque PSMA is obtained by a set of five PCRs on cDNA from macaque monkey prostate prepared according to standard protocols. The following reaction conditions: 1 cycle at 94° C. for 2 minutes followed by 40 cycles with 94° C. for 1 minute, 52° C. for 1 minute and 72° C. for 1.5 minutes followed by a terminal cycle of 72° C. for 3 minutes and the following primers are used:

```
1. forward primer:
    5'-cactgtggcccaggttcgagg-3'        SEQ ID NO: 228
   reverse primer:
    5'-gacataccacacaaattcaatacgg-3'    SEQ ID NO: 229

2. forward primer:
    5'-gctctgctcgcgccgagatgtgg-3'      SEQ ID NO: 230
   reverse primer:
    5'-acgctggacaccacctccagg-3'        SEQ ID NO: 231

3. forward primer:
    5'-ggttctactgagtgggcagagg-3'       SEQ ID NO: 232
   reverse primer:
    5'-acttgttgtggctgcttggagc-3'       SEQ ID NO: 233

4. forward primer:
    5'-gggtgaagtcctatccagatgg-3'       SEQ ID NO: 234
   reverse primer:
    5'-gtgctctgcctgaagcaattcc-3'       SEQ ID NO: 235

5. forward primer:
    5'-ctcggcttcctcttcgggtgg-3'        SEQ ID NO: 236
   reverse primer:
    5'-gcatattcatttgctgggtaacctgg-3'   SEQ ID NO: 237
```

Those PCRs generate five overlapping fragments, which are isolated and sequenced according to standard protocols using the PCR primers, and thereby provided a portion of the cDNA sequence coding macaque PSMA from codon 3 to the last codon of the mature protein. To generate a construct for expression of macaque PSMA a cDNA fragment is obtained by gene synthesis according to standard protocols (the cDNA and amino acid sequence of the construct is listed under SEQ ID NO: 238 and 239). In this construct the coding sequence of macaque PSMA from amino acid 3 to the last amino acid of the mature PSMA protein followed by a stop codon is fused in frame to the coding sequence of the first two amino acids of the human PSMA protein. The gene synthesis fragment is also designed as to contain a Kozak site for eukaryotic expression of the construct and restriction sites at the beginning and the end of the fragment containing the cDNA. The introduced restriction sites, XbaI at the 5' end and SalI at the 3' end, are utilised in the following cloning procedures. The gene synthesis fragment is cloned via XbaI and SalI into a plasmid designated pEF-DHFR (pEF-DHFR is described in Raum et al. Cancer Immunol Immunother 50 (2001) 141-150) following standard protocols. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

2.16 Flow Cytometric Analysis of Cross-species Specificity of Bispecific Antibodies Directed at Membrane-proximal Target Epitopes of Human PSMA In order to test the cross-species specificity of bispecific antibodies directed at membrane-proximal target epitopes of human PSMA the capability of the constructs to bind to macaque PSMA and macaque CD3, respectively, is investigated by FACS analysis. For this purpose the macaque PSMA transfected CHO cells as described in example 2.15 and the macaque T cell line 4119LnPx (kindly provided by Prof Fickenscher, Hygiene Institute, Virology, Erlangen-Nuernberg; published in Knappe A, et al., and Fickenscher H., Blood 2000, 95, 3256-61) are used. 200,000 cells of the respective cell lines are incubated for 30 min on ice with 50 µl of cell culture supernatant of transfected cells expressing the cross-species specific bispecific antibody constructs. The cells are washed twice in PBS with 2% FCS and binding of the construct is detected with a murine Penta His antibody (Qiagen; diluted 1:20 in 50 µl PBS with 2% FCS). After washing, bound anti His antibodies are detected with an Fc gamma-specific antibody (Dianova) conjugated to phycoerythrin, diluted 1:100 in PBS with 2% FCS. Supernatant of untransfected cells is used as a negative control. Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

Example 3

3.1. Generation of PSMA- and CD3-directed Bispecific Single Antibodies

Bispecific single chain antibodies comprising either scFv binding domain P1, P2, P3, P4 or P5 against a PSMA-epitope of <60° membrane-distance or scFv binding domain D1 or D2 against a PSMA-epitope of ≥60° membrane-distance and the scFv binding domain I2C directed at CD3epsilon on human T cells were obained by gene synthesis. The gene synthesis fragments were designed as to contain first a Kozak site for eukaryotic expression of the construct, followed by a 19 amino acid immunoglobulin leader peptide, followed in frame by the coding sequence of the bispecific single chain antibody, followed in frame by the coding sequence of a 6 histidine tag and a stop codon. The variable region arrangements as well as the SEQ ID Nos of the cDNA- and amino acid sequences are listed in the table 3 below.

TABLE 3

| SEQ ID (nucl/prot) | Formats of protein constructs (N → C) |
| --- | --- |
| 281/280 | PSMA-P1 LH x I2C HL |
| 295/294 | PSMA-P2 LH x I2C HL |
| 309/308 | PSMA-P3 LH x I2C HL |
| 323/322 | PSMA-P4 LH x I2C HL |
| 337/336 | PSMA-P5 LH x I2C HL |
| 351/350 | PSMA-D1 LH x I2C HL |
| 365/364 | PSMA-D2 LH x I2C HL |

The gene synthesis fragments were also designed as to introduce suitable restriction sites at the beginning (EcoRI) and at the end of the fragment (Sal I) for cloning of the gene synthesis fragment into the mammalian cell expression vector pEF-DHFR (pEF-DHFR is described in Raum et al. Cancer Immunol Immunother 50 (2001) 141-150). The aforementioned procedures were carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence was transfected into DHFR deficient CHO cells for eukaryotic expression of the construct.

Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX. After two passages of stationary culture cell culture supernatant was collected and used in the subsequent experiments.

3.2. Membrane-distance <60 Å or ≥60 Å of PSMA-epitopes Recognized by I2C-based PSMA-directed bscAbs Epitope confirmation of PSMA-directed bispecific single antibodies was carried out by flowcytometry on CHO cells transfected with (unmutated) human PSMA, unmutated rat PSMA and rat PSMA mutated to the homologous human amino acid at every mismatched amino acid position with a membrane-distance of ≥60 Å as described in Example 2.

200,000 cells of each CHO-transfectant were incubated for 30 min on ice with 50 µl of cell culture supernatant of transfected cells expressing the PSMA-directed bispecific antibody constructs. The cells were washed twice in PBS with 2% FCS and binding of the construct was detected with a murine Penta His antibody (Qiagen; diluted 1:20 in 50 µl PBS with 2% FCS). After washing, bound anti H is antibodies were detected with an Fc gamma-specific antibody (Dianova) conjugated to phycoerythrin, diluted 1:100 in PBS with 2% FCS. Cell culture medium was used as a negative control. Flowcytometry was performed on a FACS-Calibur apparatus, the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

Figure 4:
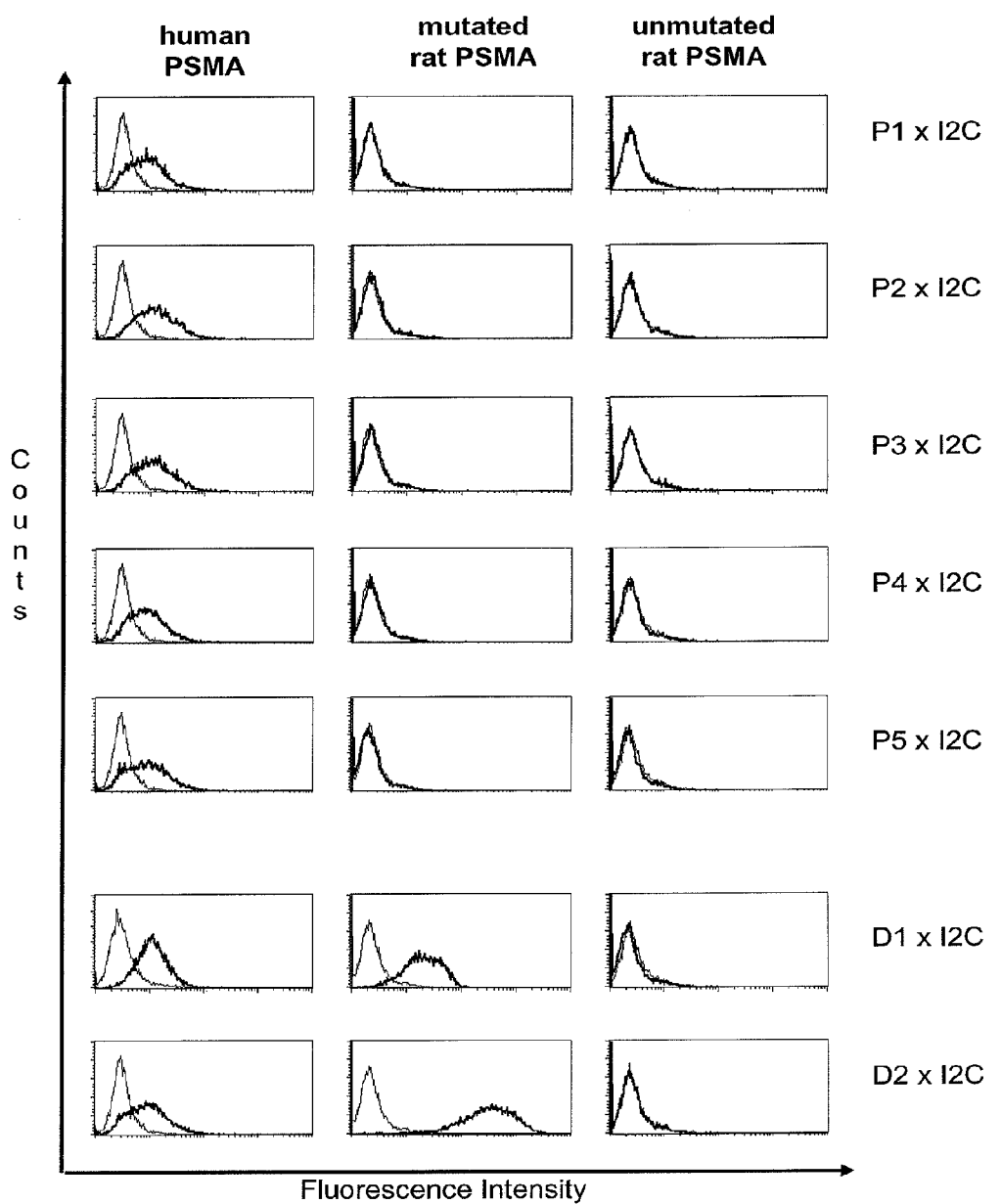

FIG. 4 shows, that PSMA-directed bscAbs P1×I2C, P2×I2C, P3×I2C, P4×I2C and P5×I2C bind to (unmutated) human PSMA but neither to unmutated nor to mutated rat PSMA and thus confirms a membrane-distance of <60 Å for the PSMA-epitope of each of these bispecific constructs. By contrast, PSMA-directed bscAbs D1×I2C and D2×I2C do not bind to unmutated rat PSMA but to (unmutated) human and mutated rat PSMA consistent with PSMA-epitopes of a membrane-distance 60 Å.

3.3. Relative T Cell Cytotoxicity Redirected by I2C-based PSMA-directed bscAbs with PSMA-epitopes of a Membrane-distance <60 Å and ≥60 Å

T cell cytotoxicity redirected by I2C-based PSMA-directed bscAbs against CHO cells transfected with human PSMA was measured in a chromium 51 ($^{51}$Cr) release assay. As source of effector T cells stimulated human CD4/CD56 depleted PBMC were used. Stimulated human PBMC were obtained as follows: A Petri dish (145 mm diameter, Greiner bio-one GmbH, Kremsmunster) was coated with a commercially available anti-CD3 specific antibody (e.g. OKT3, Orthoclone) in a final concentration of 1 µg/ml for 1 hour at 37° C. Unbound protein was removed by one washing step with PBS. The fresh PBMC were isolated from peripheral blood (30-50 ml human blood) by Ficoll gradient centrifugation according to standard protocols. 3-5×10$^7$ PBMC were added to the precoated petri dish in 120 ml of RPMI 1640 with stabilized glutamine/10% FCS/IL-2 20 U/ml (Proleukin, Chiron) and stimulated for 2 days. On the third day the cells were collected and washed once with RPMI 1640. IL-2 was added to a final concentration of 20 U/ml and the cells were cultured again for one day in the same cell culture medium as above.

By depletion of CD4+ T cells and CD56+ NK cells according to standard protocols CD8+ cytotoxic T lymphocytes (CTLs) were enriched. Target cells were washed twice with PBS and labelled with 11.1 MBq $^{51}$Cr in a final volume of 100 µl RPMI with 50% FCS for 60 minutes at 37° C. Subsequently the labelled target cells were washed 3 times with 5 ml RPMI and then used in the cytotoxicity assay. The assay was performed in a 96 well plate in a total volume of 250 µl supplemented RPMI (as above) with an E:T cell ratio of 10:1. I2C-based PSMA-directed bscAbs were added as culture supernatants from transfected CHO cells at different dilutions. The assay time was 18 hours. Cytotoxicity was measured as relative values of released chromium related to the difference of maximum lysis (addition of Triton-X) and spontaneous lysis (without effector cells). All measurements were carried out in quadruplicates. Measurement of released chromium activity was performed with a Wizard® 3" gamma-counter (Perkin Elmer Life Sciences GmbH, Koln, Germany). Analysis of the experimental data was performed with Prism 4 for Windows® (version 4.02, GraphPad Software Inc., San Diego, Calif., USA). Sigmoidal dose response curves typically had $R^2$ values >0.90 as determined by the software.

Figure 5:
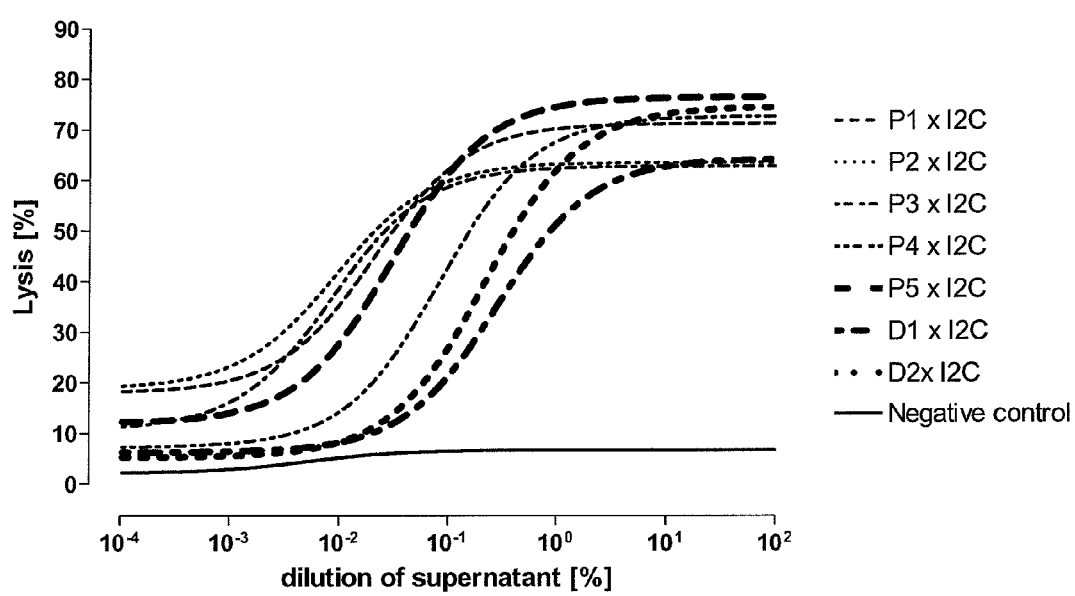

As shown in FIG. 5 all 5 PSMA-directed bscAbs, whose PSMA-epitopes have a membrane-distance of <60 Å are substantially more potent in redirecting T cell cytotoxicity than the other two PSMA-directed bscAbs, whose PSMA-epitopes have a membrane-distance of ≥60 Å.

4. Generation of Additional Bispecific Single Antibodies Directed at CD3 and Membrane-proximal Target Epitopes of Human Psma The human antibody germline VH sequence VH1 1-03 (http://vbase.mrc-cpe.cam.ac.uk/) is chosen as framework context for CDRH1 (SEQ ID NO 260), CDRH2 (SEQ ID NO 261) and CDRH3 (SEQ ID NO 262). For VH1 1-03 the following degenerated oligonucleotides have to be synthesized that overlap in a terminal stretch of approximately 15-20 nucleotides (to this end every second primer is an antisense primer):

```
5'P6-VH-A-XhoI
                                    (SEQ ID NO: 449)
CTT GAT CTC GAG TCC GGC SCT GAG STG RWG AAG CCT
GGC GCC TCC GTG AAG RTG TCC TGC AAG GCC TCC GGC
TAC

3'P6-VH-B
                                    (SEQ ID NO: 450)
CCA TTC CAG CMS CTG GCC GGG TKY CTG TYT CAC CCA
GTG CAT CAC GTA GCC GGT GAA GGT GTA GCC GGA GGC
CTT GCA

5'P6-VH-C
                                    (SEQ ID NO: 451)
CCC GGC CAG SKG CTG GAA TGG ATS GGC TAC ATC AAC
CCT TAC AAC GAC GTG ACC CGG TAC AAC GGC AAG TTC
AAG

3'P6-VH-D
                                    (SEQ ID NO: 452)
TTC CAT GTA GGC GGT GGA GGM GKA CKT GTC KCT GGT
AAK GGT GRC TYT GCC CTT GAA CTT GCC GTT GTA

5'P6-VH-E
                                    (SEQ ID NO: 453)
TCC ACC GCC TAC ATG GAA CTG TCC RGC CTG ASG TCT
GAG GAC ACC GCC GTG TAC TAC TGC GCC AGG GGC

3'P6-VH-F-BstEII
                                    (SEQ ID NO: 454)
CGA TAC GGT GAC CAG AGT GCC TCT GCC CCA GGA GTC
GAA GTA GTA CCA GTT CTC GCC CCT GGC GCA GTA GTA
```

This primer-set spans over the whole VH sequence.

Within this set primers are mixed in equal amounts (e.g. 1 µl of each primer (primer stocks 20 to 100 µM) to a 20 µl PCR reaction) and added to a PCR mix consisting of PCR buffer, nucleotides and Taq polymerase. This mix is incubated at 94° C. for 3 minutes, 65° C. for 1 minute, 62° C. for 1 minute, 59° C. for 1 minute, 56° C. for 1 minute, 52° C. for 1 minute, 50° C. for 1 minute and at 72° C. for 10 minutes in a PCR cycler. Subsequently the product is run in an agarose gel electrophoresis and the product of a size from 200 to 400 isolated from the gel according to standard methods.

The VH PCR product is then used as a template for a standard PCR reaction using primers that incorporate N-terminal and C-terminal suitable cloning restriction sites. The DNA fragment of the correct size (for a VH approximately 350 nucleotides) is isolated by agarose gel electrophoresis according to standard methods. In this way sufficient VH DNA fragment is amplified.

The human antibody germline VL sequence Vkll A1 (http://vbase.mrc-cpe.cam.ac.uk/) is chosen as framework context for CDRL1 (SEQ ID NO: 255), CDRL2 (SEQ ID NO: 256) and CDRL3 (SEQ ID NO: 257). For Vkll A1 the following degenerated oligonucleotides have to be synthesized that overlap in a terminal stretch of approximately 15-20 nucleotides (to this end every second primer is an antisense primer):

```
5'P6-VL-A-SacI
                                       (SEQ ID NO: 455)
CTT GAT GAG CTC GTG ATG ACC CAG TCT CCA SYC TCC
CTG SCT GTG ACT CTG GGC CAG CSG GCC TCC ATC TCT
TGC CGG

3'P6-VL-B
                                       (SEQ ID NO: 456)
CCA GTG CAT GAA GGT GTT GTC GTA GGA GTC GAT GGA
CTC GGA GGC CCG GCA AGA GAT GGA GGC

5'P6-VL-C
                                       (SEQ ID NO: 457)
ACC TTC ATG CAC TGG TWT CAG CAG ARG CCT GGC CAG
YCT CCT MRC CKG CTG ATC TWC CGG GCC TCT ATC CTG
GAA

3'P6-VL-D
                                       (SEQ ID NO: 458)
CAG GGT GAA GTC GGT GCC GGA GCC AGA GCC GGA GAA
CCG GKC AGG GAY GCC GGA TTC CAG GAT AGA GGC CCG

5'P6-VL-E
                                       (SEQ ID NO: 459)
ACC GAC TTC ACC CTG AMA ATC TMC CST GTG GAG GCC
GAS GAC GTG GSC RYC TAC TAC TGC CAC CAG

3'P6-VL-F-BsiWI/SpeI
                                       (SEQ ID NO: 460)
ACT CAG ACT AGT CGT ACG CTT GAT TTC CAG CTT GGT
CCC TCC GCC GAA GGT GTA AGG GTC CTC GAT GGA CTG
GTG GCA GTA GTA
```

This primer-set spans over the whole corresponding VL sequence.

Within this set primers are mixed in equal amounts (e.g. 1 µl of each primer (primer stocks 20 to 100 µM) to a 20 µl PCR reaction) and added to a PCR mix consisting of PCR buffer, nucleotides and Taq polymerase. This mix is incubated at 94° C. for 3 minutes, 65° C. for 1 minute, 62° C. for 1 minute, 59° C. for 1 minute, 56° C. for 1 minute, 52° C. for 1 minute, 50° C. for 1 minute and at 72° C. for 10 minutes in a PCR cycler. Subsequently the product is run in an agarose gel electrophoresis and the product of a size from 200 to 400 isolated from the gel according to standard methods.

The VL PCR product is then used as a template for a standard PCR reaction using primers that incorporate N-terminal and C-terminal suitable cloning restriction sites. The DNA fragment of the correct size (for a VL approximately 330 nucleotides) is isolated by agarose gel electrophoresis according to standard methods. In this way sufficient VL DNA fragment is amplified.

The final VH1 1-03-based VH PCR product (i.e. the repertoire of human/humanized VH) is combined with the final VkII A1-based VL PCR product (i.e. the repertoire of human/humanized VL) in the phage display vector pComb3H5Bhis. This VH-VL combination forms a library of functional scFvs from which—after display on filamentous phage—anti-PSMA binders are selected, screened, identified and confirmed as described in the following:

450 ng of the light chain fragments (SacI-SpeI digested) are ligated with 1400 ng of the phagemid pComb3H5Bhis (SacI-SpeI digested; large fragment). The resulting combinatorial antibody library is then transformed into 300 ul of electrocompetent *Escherichia coli* XL1 Blue cells by electroporation (2.5 kV, 0.2 cm gap cuvette, 25 uFD, 200 Ohm, Biorad gene-pulser) resulting in a library size of more than $10^7$ independent clones. After one hour of phenotype expression, positive transformants are selected for carbenicilline resistance encoded by the pComb3H5BHis vector in 100 ml of liquid super broth (SB)-culture over night. Cells are then harvested by centrifugation and plasmid preparation is carried out using a commercially available plasmid preparation kit (Qiagen).

2800 ng of this plasmid-DNA containing the VL-library (XhoI-BstEII digested; large fragment) are ligated with 900 ng of the heavy chain V-fragments (XhoI-BstEII digested) and again transformed into two 300 ul aliquots of electrocompetent *E. coli* XL1 Blue cells by electroporation (2.5 kV, 0.2 cm gap cuvette, 25 uFD, 200 Ohm) resulting in a total VH-VL scFv (single chain variable fragment) library size of more than $10^7$ independent clones.

After phenotype expression and slow adaptation to carbenicilline, the *E. coli* cells containing the antibody library are transferred into SB-carbenicilline (SB with 50 ug/mL carbenicilline) selection medium. The *E. coli* cells containing the antibody library is then infected with an infectious dose of $10^{12}$ particles of helper phage VCSM13 resulting in the production and secretion of filamentous M13 phage, wherein phage particle contains single stranded pComb3H5BHis-DNA encoding a scFv-fragment and displayed the corresponding scFv-protein as a translational fusion to phage coat protein III. This pool of phages displaying the antibody library is used for the selection of antigen binding entities.

For this purpose the phage library carrying the cloned scFv-repertoire is harvested from the respective culture supernatant by PEG8000/NaCl precipitation and centrifugation. Approximately $10^{11}$ to $10^{12}$ scFv phage particles are resuspended in 0.4 ml of PBS/0.1% BSA and incubated with $10^5$ to $10^7$ PSMA-positive human prostate cancer cell line LNCaP (ATCC No. CRL-1740) for 1 hour on ice under slow agitation. These LNCaP cells are harvested beforehand by centrifugation, washed in PBS and resuspended in PBS/1% FCS (containing 0.05% Na Azide). scFv phage which do not specifically bind to LNCaP cells are eliminated by up to five washing steps with PBS/1% FCS (containing 0.05% Na Azide). After washing, binding entities are eluted from the cells by resuspending the cells in HCl-glycine pH 2.2 (10 min incubation with subsequent vortexing) and after neutralization with 2 M Tris pH 12, the eluate is used for infection of a fresh uninfected *E. coli* XL1 Blue culture (OD600>0.5). The *E. coli* culture containing *E. coli* cells successfully transduced with a phagemid copy, encoding a human/humanized scFv-fragment, are again selected for carbenicilline resistance and subsequently infected with VCMS 13 helper phage to start the second round of antibody display and in vitro selection. A total of 4 to 5 rounds of selections are carried out, normally.

In order to screen for PSMA specific binders plasmid DNA corresponding to 4 and 5 rounds of panning is isolated from *E. coli* cultures after selection. For the production of soluble scFv-protein, VH-VL-DNA fragments are excised from the plasmids (Xho1-SpeI). These fragments are cloned via the same restriction sites into the plasmid pComb3H5BFlag/His differing from the original pComb3H5BHis in that the expression construct (i.e. the scFv) includes a Flag-tag (DYKDDDDK) at its C-terminus before the His6-tag and that phage protein III/N2 domain and protein III/CT domain had been deleted. After ligation, each pool (different rounds of panning) of plasmid DNA is transformed into 100 µl heat shock competent *E. coli* TG1 or XLI blue and plated onto carbenicilline LB-agar. Single colonies are picked into 100 µl of LB carb (50 ug/ml carbenicilline).

*E. coli* transformed with pComb3H5BFlag/His containing a VL- and VH-segment produce soluble scFv in sufficient amounts after induction with 1 mM IPTG. Due to a suitable signal sequence, the scFv-chain is exported into the periplasma where it folds into a functional conformation.

Single *E. coli* TG1 bacterial colonies from the transformation plates are picked for periplasmic small scale preparations and grown in SB-medium (e.g. 10 ml) supplemented with 20 mM $MgCl_2$ and carbenicilline 50 µg/ml (and re-dissolved in PBS (e.g. 1 ml) after harvesting. By four rounds of freezing at −70° C. and thawing at 37° C., the outer membrane of the bacteria is destroyed by temperature shock and the soluble periplasmic proteins including the scFvs are released into the supernatant. After elimination of intact cells and cell-debris by centrifugation, the supernatant containing the anti-PSMA scFvs is collected and used for the identification of PSMA specific binders as follows:

Binding of scFvs to PSMA is tested by flow cytometry on the PSMA-positive human prostate cancer cell line LNCaP (ATCC No. CRL-1740). A periplasmic small scale preparation as described above without any grown bacteria is used as negative control.

For flow cytometry $2.5 \times 10^5$ cells are incubated with 50 ul of scFv periplasmic preparation or with 5 µg/ml of purified scFv in 50 µl PBS with 2% FCS. The binding of scFv is detected with an anti-His antibody (Penta-His Antibody, BSA free, Qiagen GmbH, Hilden, FRG) at 2 µg/ml in 50 µl PBS with 2% FCS. As a second step reagent a R-Phycoerythrin-conjugated affinity purified F(ab')2 fragment, goat anti-mouse IgG (Fc-gamma fragment specific), diluted 1:100 in 50 µl PBS with 2% FCS (Dianova, Hamburg, FRG) is used. The samples are measured on a FACSscan (BD biosciences, Heidelberg, FRG).

Single clones are then analyzed for favourable properties and amino acid sequence. PSMA specific scFvs are converted into recombinant bispecific single chain antibodies by joining them via a $Gly_4Ser_1$-linker with the CD3 specific scFv I2C (SEQ ID NO: 185) or any other CD3 specific scFv of the invention to result in constructs with the domain arrangement $VH_{PSMA}$-$(Gly_4Ser_1)_3$-$VL_{PSMA}$-$Ser_1Gly_4Ser_1$-$VH_{cD3}$-$(Gly_4Ser_1)_3$-$VL_{CD3}$ or alternative domain arrangements such as $VL_{PSMA}$-$(Gly_4Ser_1)_3$-$VH_{PSMA}$-$Gly_4Ser_1$-$VH_{cD3}$-$(Gly_4Ser_1)_3$-$VL_{CD3}$. For expression in CHO cells the coding sequences of (i) an N-terminal immunoglobulin heavy chain leader comprising a start codon embedded within a Kozak consensus sequence and (ii) a C-terminal $His_6$-tag followed by a stop codon are both attached in frame to the nucleotide sequence encoding the bispecific single chain antibodies prior to insertion of the resulting DNA-fragment as obtained by gene synthesis into the multiple cloning site of the expression vector pEF-DHFR (Raum et al. Cancer Immunol Immunother 50 (2001) 141-150). Transfection of the generated expression plasmids is carried out as described in Example 3.1. Protein expression and purification of bispecific antibody constructs, flow cytometric confirmation of binding to CD3 and to membrane-proximal target epitopes of human PSMA as well as the analysis of bioactivity by cytotoxicity assay are performed as described in Example 2. All other state of the art procedures are carried out according to standard protocols (Sambrook, Molecular Cloning; A Laboratory Manual, 3rd edition, Cold Spring Harbour Laboratory Press, Cold Spring Harbour, N.Y. (2001)).

Only those bispecific antibody constructs that bind to CD3 and to membrane-proximal target epitopes of human PSMA and show potent recruitment of cytotoxic activity of effector T cells against target cells positive for PSMA are selected for further use.

Example 4

4.1. Generation of PSMA- and CD3-directed Bispecific Single Chain Antibodies

Bispecific single chain antibodies comprising either scFv binding domain P6 against a PSMA-epitope of <60 Å membrane-distance or scFv binding domain D3 against a PSMA-epitope of ≥60 Å membrane-distance and the scFv binding domain I2C directed at CD3epsilon on human T cells were obained by gene synthesis. The gene synthesis fragments were designed as to contain first a Kozak site for eukaryotic expression of the construct, followed by a 19 amino acid immunoglobulin leader peptide, followed in frame by the coding sequence of the bispecific single chain antibody, followed in frame by the coding sequence of a 6 histidine tag and a stop codon. The variable region arrangements as well as the SEQ ID Nos of the cDNA- and amino acid sequences are listed in the table 4 below.

TABLE 4

| SEQ ID (nucl/prot) | Formats of protein constructs (N → C) |
|---|---|
| 267/266 | PSMA-P6 LH x I2C HL |
| 253/252 | PSMA-D3 LH x I2C HL |

The gene synthesis fragments were also designed as to introduce suitable restriction sites at the beginning (EcoRI) and at the end of the fragment (Sal I) for cloning of the gene synthesis fragment into the mammalian cell expression vector pEF-DHFR (pEF-DHFR is described in Raum et al. Cancer Immunol Immunother 50 (2001) 141-150). The aforementioned procedures were carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX. After two passages of stationary culture cell culture supernatant was collected and used in the subsequent experiments.

4.2. Membrane-distance <60 Å or ≥60 Å of PSMA-epitopes Recognized by I2C-based PSMA-directed bscAbs Epitope confirmation of PSMA-directed bispecific single antibodies was carried out by flowcytometry on CHO cells transfected with (unmutated) human PSMA, unmutated rat PSMA and rat PSMA mutated to the homologous human amino acid at every mismatched amino acid position with a membrane-distance of ≥60 Å as described in Example 2.

200,000 cells of each CHO-transfectant were incubated for 30 min on ice with 50 µl of cell culture supernatant of transfected cells expressing the PSMA-directed bispecific antibody constructs. The cells were washed twice in PBS with 2% FCS and binding of the construct was detected with a murine Penta His antibody (Qiagen; diluted 1:20 in 50 µl PBS with 2% FCS). After washing, bound anti H is antibodies were detected with an Fc gamma-specific antibody (Dianova) conjugated to phycoerythrin, diluted 1:100 in PBS with 2% FCS. Cell culture medium was used as a negative control. Flowcytometry was performed on a FACS-Calibur apparatus, the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

Figure 6:
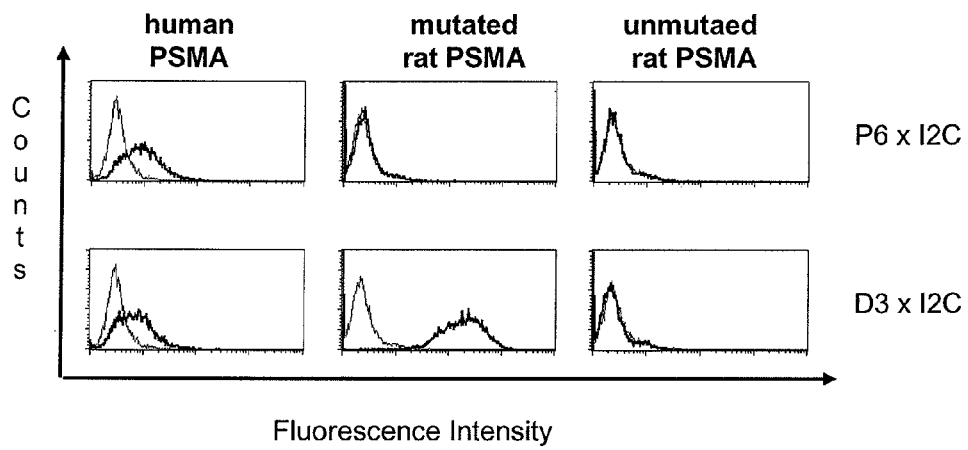

FIG. 6 shows, that PSMA-directed bscAb P6×I2C binds to (unmutated) human PSMA but neither to unmutated nor to mutated rat PSMA and thus confirms a membrane-distance of <60 Å for the PSMA-epitope of this bispecific construct. By contrast, PSMA-directed bscAb D3×I2C does not bind to unmutated rat PSMA but to (unmutated) human and mutated rat PSMA consistent with a PSMA-epitope of a membrane-distance ≥60 Å.

4.3. Relative T Cell Cytotoxicity Redirected by I2C-based PSMA-directed bscabs with PSMA-epitopes of a Membrane-distance <60 Å and ≥60 Å

T cell cytotoxicity redirected by I2C-based PSMA-directed bscAbs against CHO cells transfected with human PSMA was measured in a chromium 51 ($^{51}$Cr) release assay. As source of effector T cells stimulated human CD4/CD56 depleted PBMC were used. Stimulated human PBMC were obtained as follows: A Petri dish (145 mm diameter, Greiner bio-one GmbH, Kremsmunster) was coated with a commercially available anti-CD3 specific antibody (e.g. OKT3, Orthoclone) in a final concentration of 1 µg/ml for 1 hour at 37° C. Unbound protein was removed by one washing step with PBS. The fresh PBMC were isolated from peripheral blood (30-50 ml human blood) by Ficoll gradient centrifugation according to standard protocols. 3-5×10$^7$ PBMC were added to the precoated petri dish in 120 ml of RPMI 1640 with stabilized glutamine/10% FCS/IL-2 20 U/ml (Proleukin, Chiron) and stimulated for 2 days. On the third day the cells were collected and washed once with RPMI 1640. IL-2 was added to a final concentration of 20 U/ml and the cells were cultured again for one day in the same cell culture medium as above.

Figure 7:
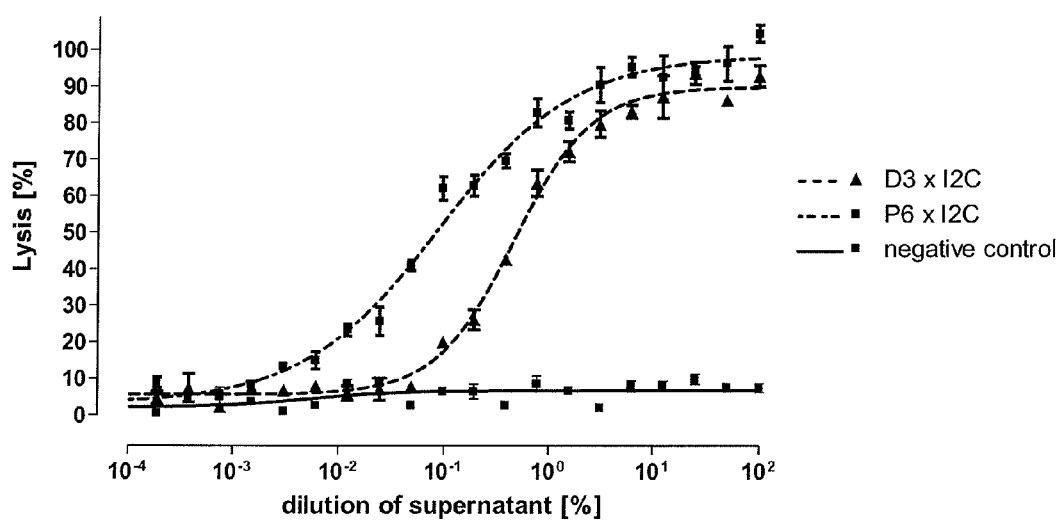

By depletion of CD4+ T cells and CD56+ NK cells according to standard protocols CD8+ cytotoxic T lymphocytes (CTLs) were enriched. Target cells were washed twice with PBS and labelled with 11.1 MBq $^{51}$Cr in a final volume of 100 µl RPMI with 50% FCS for 60 minutes at 37° C. Subsequently the labelled target cells were washed 3 times with 5 ml RPMI and then used in the cytotoxicity assay. The assay was performed in a 96 well plate in a total volume of 250 µl supplemented RPMI (as above) with an E:T cell ratio of 10:1. I2C-based PSMA-directed bscAbs were added as culture supernatants from transfected CHO cells at different dilutions. The assay time was 18 hours. Cytotoxicity was measured as relative values of released chromium related to the difference of maximum lysis (addition of Triton-X) and spontaneous lysis (without effector cells). All measurements were carried out in quadruplicates. Measurement of released chromium activity was performed with a Wizard® 3" gammacounter (Perkin Elmer Life Sciences GmbH, Koln, Germany). Analysis of the experimental data was performed with Prism 4 for Windows® (version 4.02, GraphPad Software Inc., San Diego, Calif., USA). Sigmoidal dose response curves typically had $R^2$ values >0.90 as determined by the software. As shown in FIG. 7 the PSMA-directed bscAb P6×I2C, whose PSMA-epitope has a membrane-distance of <60 Å is substantially more potent in redirecting T cell cytotoxicity than PSMA-directed bscAb D3×I2C, whose PSMA-epitope has a membrane-distance of 60 Å.

Example 5

Crossreactive Binding to Human and Non-chimpanzee Primate PSMA and CD3 of I2C-based bscAbs Against Membrane-proximal PSMA-Eptitopes 5.1. Cloning and Expression of Cyno PSMA Antigen on CHO Cells The cDNA sequence of macaque PSMA was obtained as described in Example 2.15 As described above, these PCRs generated five overlapping fragments, which were isolated and sequenced according to standard protocols using the PCR primers, and thereby provided a portion of the cDNA sequence coding macaque PSMA from codon 3 to the last codon of the mature protein. To generate a construct for expression of macaque PSMA a cDNA fragment was obtained by gene synthesis according to standard protocols (the cDNA and amino acid sequence of the construct is listed under SEQ ID Nos 238 and 239). In this construct the coding sequence of macaque PSMA from amino acid 3 to the last amino acid of the mature PSMA protein followed by a stop codon was fused in frame to the coding sequence of the first two amino acids of the human PSMA protein. The gene synthesis fragment was also designed as to contain a Kozak site for eukaryotic expression of the construct and restriction sites at the beginning and the end of the fragment containing the cDNA. The introduced restriction sites, XbaI at the 5' end and SalI at the 3' end, were utilised in the following cloning procedures. The gene synthesis fragment was cloned via XbaI and SalI into a plasmid designated pEF-DHFR following standard protocols. The aforementioned procedures were carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX.

5.2. Flow Cytometric Binding Analysis of I2C-based Bscabs Against Membrane-proximal Eptitopes of Human PSMA on Non-chimanzee Primate PSMA and on Human and Non-chimpanzee Primate CD3

Binding of bscAbs P1×I2C, P2×I2C, P3×I2C, P4×I2C, P5×I2C and P6×I2C directed against membrane-proximal PSMA-epitopes to CHO cells expressing human PSMA is shown by flowcytometry in Examples 3 and 4.

Figure 8:
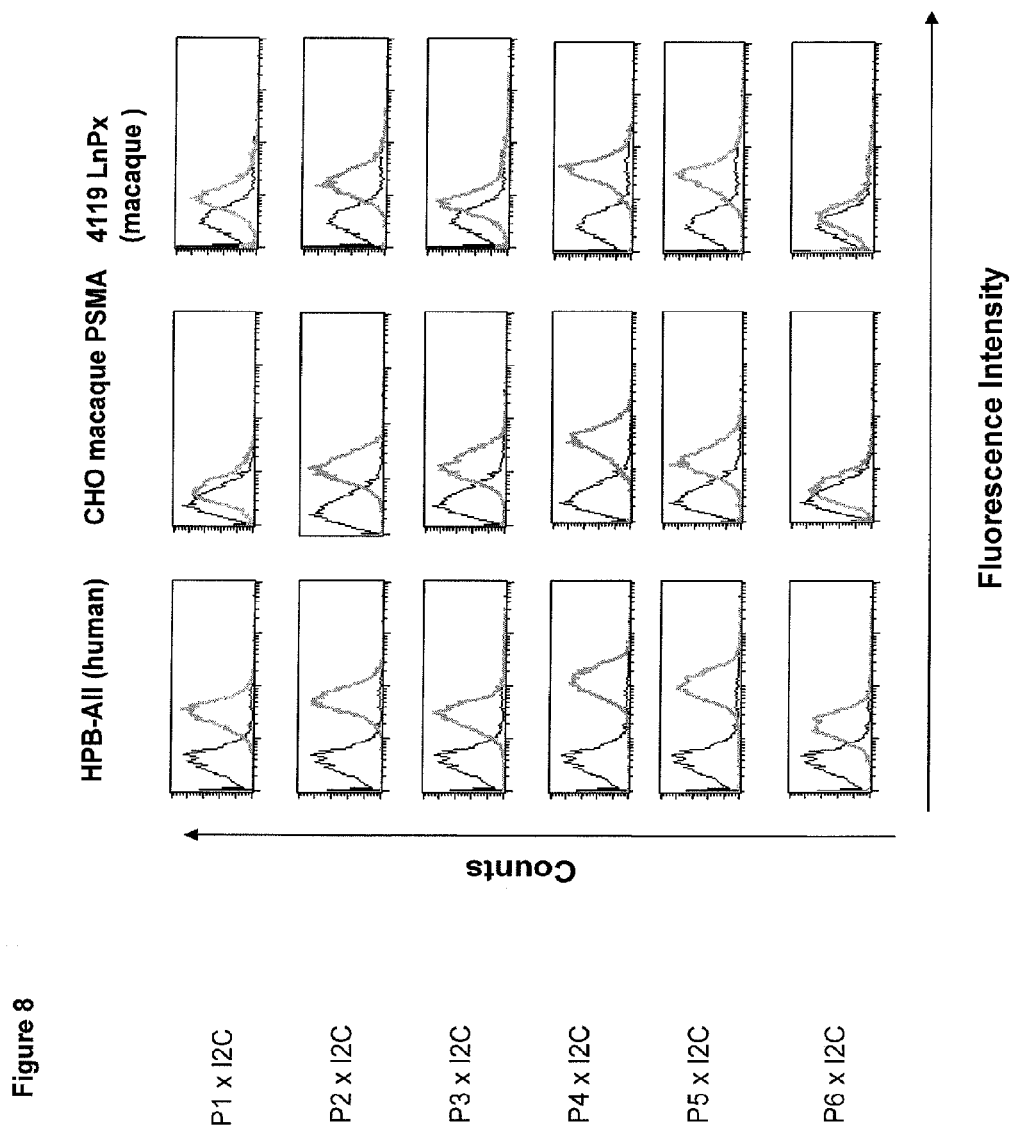

Binding of these bscAbs to macaque PSMA as well as to human and macaque CD3 was analysed by flowcytometry using CHO cells transfected with macaque PSMA, the human CD3 positive T cell leukemia cell line HPB-ALL (DSMZ, Braunschweig, ACC483) and the CD3 positive macaque T cell line 4119LnPx (kindly provided by Prof Fickenscher, Hygiene Institute, Virology, Erlangen-Nuernberg; published in Knappe A, et al., and Fickenscher H., Blood 2000, 95, 3256-61). Results are shown in FIG. 8. 200,000 cells of the respective cell population were incubated for 30 min on ice with 50 µl of cell culture supernatant of CHO cells transfected with the PSMA-directed bispecific antibody constructs. The cells were washed twice in PBS and binding of the construct was detected with an unlabeled murine Penta His antibody (Qiagen; diluted 1:20 in 50 µl PBS with 2% FCS). After washing, bound anti His antibodies were detected with an Fc gamma-specific antibody (Dianova) conjugated to phycoerythrin, diluted 1:100 in 50 µl PBS with 2% FCS. Fresh culture medium was used as a negative control.

Flow cytometry was performed on a FACS-Calibur apparatus, the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

6. Generation of Bispecific Single Chain Antibodies Directed at Membrane-proximal Target Epitopes of Human FAPalpha 6.1 Generation of CHO Cells Expressing Human FAPalpha The coding sequence of human FAPalpha as published in GenBank (Accession number NM_004460) is obtained by gene synthesis according to standard protocols. The gene synthesis fragment is designed as to contain first a Kozak site for eukaryotic expression of the construct followed by the coding sequence of the human FAPalpha protein and a stop codon (the cDNA and amino acid sequence of the construct is listed under SEQ ID Nos 366 and 367). The gene synthesis fragment is also designed as to introduce restriction sites at the beginning and at the end of the fragment. The introduced restriction sites, XmaI at the 5' end and SalI at the 3' end, are utilized in the following cloning procedures. The gene synthesis fragment is cloned via XmaI and SalI into a plasmid designated pEF-DHFR (pEF-DHFR is described in Raum et al. Cancer Immunol Immunother 50 (2001) 141-150) following standard protocols. The aforementioned procedures are all carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

6.2 Generation of a Soluble Human FAPalpha Fusion Protein

The coding sequence of human FAPalpha as described in Example 6.1 and the coding sequence of murine Lag3 as published in Gen Bank (Accession number NM_008479) are used for the construction of an artificial cDNA sequence encoding a soluble fusion protein of human FAPalpha and murine Lag3. To generate a construct for expression of the soluble human FAPalpha fusion protein a cDNA fragment is obtained by gene synthesis according to standard protocols (the cDNA and amino acid sequence of the construct is listed under SEQ ID Nos 368 369). The gene synthesis fragment is designed as to contain first a Kozak site for eukaryotic expression of the construct followed by the coding sequence of the murine Lag3 protein from amino acid 1 to 441 corresponding to the signal peptide and extracellular domains of murine Lag3, followed in frame by the coding sequence of an artificial $Ser_1$-$Gly_4$-$Ser_1$-linker, followed in frame by the coding sequence of the human FAPalpha protein from amino acid 27 to 760 corresponding to the extracellular domains of human FAPalpha, followed in frame by the coding sequence of an artificial $Ser_1$-$Gly_1$-linker, followed in frame by the coding sequence of a 6 histidine tag and a stop codon. The gene synthesis fragment is also designed as to introduce restriction sites at the beginning and at the end of the fragment. The introduced restriction sites, SpeI at the 5' end and SalI at the 3' end, are utilized in the following cloning procedures. The gene synthesis fragment is cloned via SpeI and SalI into a plasmid designated pEF-DHFR (pEF-DHFR is described in Raum et al. Cancer Immuno) Immunother 50 (2001) 141-150) following standard protocols. The aforementioned procedures are all carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX. After two passages of stationary culture the cells are grown in roller bottles with nucleoside-free HyQ PF CHO liquid soy medium (with 4.0 mM L-Glutamine with 0.1% Pluronic F-68; HyClone) for 7 days before harvest. The cells are removed by centrifugation and the supernatant containing the expressed protein is stored at −20° C. Alternatively a clone of the expression plasmid with sequence-verified nucleotide sequence is used for transfection and protein expression in the FreeStyle 293 Expression System (Invitrogen GmbH, Karlsruhe, Germany) according to the manufacturer's protocol. Supernatant containing the expressed protein is obtained, cells are removed by centrifugation and the supernatant is stored at −20° C.

Purification of the soluble human FAPalpha fusion protein is performed as follows: Äkta® Explorer System (GE Health Systems) and Unicorn® Software are used for chromatography. Immobilized metal affinity chromatography ("IMAC") is performed using a Fractogel EMD Chelate® (Merck) which is loaded with $ZnCl_2$ according to the protocol provided by the manufacturer. The column is equilibrated with buffer A (20 mM sodium phosphate buffer pH 7.2, 0.1 M NaCl) and the cell culture supernatant (500 ml) is applied to the column (10 ml) at a flow rate of 3 ml/min. The column is washed with buffer A to remove unbound sample. Bound protein is eluted using a two step gradient of buffer B (20 mM sodium phosphate buffer pH 7.2, 0.1 M NaCl, 0.5 M Imidazole) according to the following procedure:

Step 1: 20% buffer B in 6 column volumes
Step 2: 100% buffer B in 6 column volumes Eluted protein fractions from step 2 are pooled for further purification. All chemicals are of research grade and purchased from Sigma (Deisenhofen) or Merck (Darmstadt).

Gel filtration chromatography is performed on a HiLoad 16/60 Superdex 200 prep grade column (GE/Amersham) equilibrated with Equi-buffer (25 mM Citrate, 200 mM Lysine, 5% Glycerol, pH 7.2). Eluted protein samples (flow rate 1 ml/min) are subjected to standard SDS-PAGE and Western Blot for detection. Prior to purification, the column is calibrated for molecular weight determination (molecular weight marker kit, Sigma MW GF-200). Protein concentrations are determined using OD280 nm.

6.3 Generation of CHO Cells Expressing Murine Fapalpha

The sequence of murine FAPalpha (NM_007986, *Mus musculus* fibroblast activation protein (Fap), mRNA, National Center for Biotechnology Information, http://www.ncbi.nlm.nih.gov/entrez) is used to obtain a synthetic cDNA molecule by gene synthesis according to standard protocols. The gene synthesis fragment is designed as to contain first a Kozak site for eukaryotic expression of the construct followed by the coding sequence of the complete murine FAPalpha antigen, followed in frame by the coding sequence of a FLAG-tag and a stop codon (the cDNA and amino acid sequence of the construct is listed under SEQ ID Nos 370 and 371). An alternative construct identical to the aforementioned construct except for a C-terminal 6 Histidine-tag instead of the FLAG-tag is also generated. The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150). The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX. Cell surface expression of murine FAPalpha by the generated transfectants is confirmed by flow cytometric binding analysis performed as described herein. In the case of the construct with the 6 Histidine tag a murine Penta His antibody (Qiagen; diluted 1:20 in 50 µl PBS with 2% FCS) was used and detected with an Fc gamma-specific antibody (Dianova) conjugated to phycoerythrin. Expression of murine FAPalpha was confirmed as shown in FIG. 10.

6.4 Generation of CHO Cells Expressing a Mutated Human FAPalpha Antigen with Murine Membrane-distal Epitopes The coding sequence of a mutated human FAPalpha antigen with murine membrane-distal epitopes is obtained by gene synthesis according to standard protocols. The gene synthesis fragment is designed as to contain first a Kozak site for eukaryotic expression of the construct followed by the coding sequence of the complete human FAPalpha antigen mutated at 15 specific amino acid positions as explained below, followed in frame by the coding sequence of a FLAG-tag and a stop codon (the cDNA and amino acid sequence of the construct is listed under SEQ ID Nos 372 and 373). All extracellular amino acids of human FAPalpha mismatching with the homologous murine sequence, whose alpha C-atoms have a distance of ≥60 Å from the alpha C-atom of the thirteenth extracellular amino acid (i.e. the reference aa) as counted from the junction of transmembrane and extracellular region, are mutated to the homologous mismatched murine amino acid. This applies to the 15 amino acids that are listed in table 2 and marked in bold. The homologous mismatched amino acids between human and murine FAPalpha are identified by sequence alignment as shown in FIG. 9. The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150). Internal restriction sites are removed by silent mutation of the coding sequence in the gene synthesis fragment. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

Cell surface expression of mutated human FAPalpha with murine membrane-distal epitopes by the generated transfectants is confirmed by flow cytometric binding analysis performed as described herein using an anti-FLAG M2 antibody (Sigma-Aldrich, Inc.; diluted 1:900 in 50 µl PBS with 2% FCS) detected with an Fc gamma-specific antibody (Dianova) conjugated to phycoerythrin. Expression of mutated human FAPalpha with murine membrane-distal epitopes was confirmed as shown in FIG. 10.

6.5 Generation of CHO Cells Expressing a Mutated Murine FAPalpha Antigen with Human Membrane-distal Epitopes The coding sequence of a mutated murine FAPalpha antigen with human membrane-distal epitopes is obtained by gene synthesis according to standard protocols. The gene synthesis fragment is designed as to contain first a Kozak site for eukaryotic expression of the construct followed by the coding sequence of the complete murine FAPalpha antigen mutated at the same 15 specific extracellular amino acid positions as identified in the foregoing Example 6.4 to the respective homologous human amino acid, followed in frame by the coding sequence of a FLAG tag and a stop codon (the cDNA and amino acid sequence of the construct is listed under SEQ ID Nos 374 and 375). The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150). The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

6.6 Immunization of Mice Using a Soluble Human FAPalpha Fusion Protein

Twelve weeks old F1 mice from BALB/c×C57BL/6 crossings are immunized with the soluble human FAPalpha fusion protein as described in Example 6.2. To this end for each animal 40 µg of the soluble human FAPalpha fusion protein are mixed with 10 nmol of a thioate-modified CpG-Oligonucleotide (5'-tccatgacgttcctgatgct-3') in 300 µl PBS and are injected intraperitoneally. Mice receive booster immunizations after 21, 42 and optionally 63 days in the same way. Ten days after the first booster immunization, blood samples are taken and antibody serum titers against human FAPalpha are tested by flow cytometry according to standard protocols. To this end 200,000 cells of the human FAPalpha transfected CHO cells as described in Example 6.1 are incubated for 30 min on ice with 50 µl of serum of the immunized animals diluted 1:1000 in PBS with 2% FCS. The cells are washed twice in PBS with 2% FCS and binding of serum antibodies is detected with a mouse Fc gamma-specific antibody (Dianova) conjugated to phycoerythrin, diluted 1:100 in PBS with 2% FCS. Serum of the animals obtained prior to immunization is used as a negative control.

Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

Animals demonstrating significant serum reactivity against human FAPalpha as determined by the FACS analysis are used in the subsequent experiment.

6.7 Generation of an Immune Murine Antibody scFV Library: Construction of a Combinatorial Antibody Library and Phage Display Three days after the last booster immunization spleen cells of reactive animals are harvested for the preparation of total RNA according to standard protocols.

A library of murine immunoglobulin (Ig) light chain (kappa) variable region (VK) and Ig heavy chain variable region (VH) DNA-fragments is constructed by RT-PCR on murine spleen RNA using VK- and VH specific primers. cDNA is synthesized according to standard protocols, see example 2.7.

450 ng of the kappa light chain fragments (SacI-SpeI digested) are ligated with 1400 ng of the phagemid pComb3H5Bhis (SacI-SpeI digested; large fragment). The resulting combinatorial antibody library is then transformed into 300 µl of electrocompetent *Escherichia coli* XL1 Blue cells by electroporation (2.5 kV, 0.2 cm gap cuvette, 25 µFD, 200 Ohm, Biorad gene-pulser) resulting in a library size of more than $10^7$ independent clones. After one hour of phenotype expression, positive transformants are selected for carbenicillin resistance encoded by the pComb3H5BHis vector in 100 ml of liquid super broth (SB)-culture over night. Cells are then harvested by centrifugation and plasmid preparation is carried out using a commercially available plasmid preparation kit (Qiagen).

2800 ng of this plasmid-DNA containing the VK-library (XhoI-BstEII digested; large fragment) are ligated with 900 ng of the heavy chain V-fragments (XhoI-BstEII digested) and again transformed into two 300 µl aliquots of electrocompetent *E. coli XL*1 Blue cells by electroporation (2.5 kV, 0.2 cm gap cuvette, 25 µFD, 200 Ohm) resulting in a total VH-VK scFv (single chain variable fragment) library size of more than $10^7$ independent clones.

After phenotype expression and slow adaptation to carbenicillin, the *E. coli* cells containing the antibody library are transferred into SB-Carbenicillin (SB with 50 µg/mL carbenicillin) selection medium. The *E. coli* cells containing the antibody library are then infected with an infectious dose of $10^{12}$ particles of helper phage VCSM13 resulting in the production and secretion of filamentous M13 phage, wherein each phage particle contains single stranded pComb3H5BHis-DNA encoding a murine scFv-fragment and displays the corresponding scFv-protein as a translational fusion to phage coat protein III. This pool of phages displaying the antibody library is later used for the selection of antigen binding entities.

6.8 Phage Display Based Selection of Membrane-proximal Target Binders on CHO Cells Expressing the Mutated Human FAPalpha Antigen with Murine Membrane-distal Epitopes The phage library carrying the cloned scFv-repertoire is harvested from the respective culture supernatant by PEG8000/NaCl precipitation and centrifugation. Approximately $10^{11}$ to $10^{12}$ scFv phage particles are resuspended in 0.4 ml of PBS/0.1% BSA and incubated with $10^5$ to $10^7$ CHO cells expressing the mutated human FAPalpha antigen with murine membrane-distal epitopes as described in example 6.4 for 1 hour on ice under slow agitation. These CHO cells are grown beforehand, harvested by centrifugation, washed in PBS and resuspended in PBS/1% FCS (containing Na Azide). scFv phage which do not specifically bind to the CHO cells are eliminated by up to five washing steps with PBS/1% FCS (containing Na Azide). After washing, binding entities are eluted from the cells by resuspending the cells in HCl-glycine pH 2.2 (10 min incubation with subsequent vortexing) and after neutralization with 2 M Tris pH 12, the eluate is used for infection of a fresh uninfected *E. coli* XL1 Blue culture (OD600>0.5). The *E. coli* culture containing *E. coli* cells successfully transduced with a phagemid copy, encoding a murine scFv-fragment, are again selected for carbenicillin resistance and subsequently infected with VCMS13 helper phage to start the second round of antibody display and in vitro selection. Typically a total of 4 to 5 rounds of selections are carried out.

6.9 Screening for Membrane-proximal Target Binders on CHO Cells Expressing the Human Fapalpha Antigen, the Murine Fapalpha Antigen and the Mutated Murine Fapalpha Antigen with Human Membrane-distal Epitopes Plasmid DNA corresponding to 4 and 5 rounds of panning is isolated from *E. coli* cultures after selection. For the production of soluble scFv-protein, VH-VL-DNA fragments are excised from the plasmids (XhoI-SpeI). These fragments are cloned via the same restriction sites in the plasmid pComb3H5BFlag/His differing from the original pComb3H5BHis in that the expression construct (e.g. scFv) includes a Flag-tag (TGDYKDDDDK) between the scFv and the His6-tag and the additional phage proteins are deleted. After ligation, each pool (different rounds of panning) of plasmid DNA is transformed into 100 µl heat shock competent *E. coli* TG1 or XLI blue and plated onto carbenicillin LB-agar. Single colonies are picked into 100 µl of LB carb (LB with 50 µg/ml carbenicillin).

After induction with 1 mM IPTG *E. coli* transformed with pComb3H5BFlag/His containing a VL- and VH-segment produce soluble scFv in sufficient amounts. Due to a suitable signal sequence, the scFv is exported into the periplasma where it folds into a functional conformation.

Single *E. coli* bacterial colonies from the transformation plates are picked for periplasmic small scale preparations and grown in SB-medium (e.g. 10 ml) supplemented with 20 mM $MgCl_2$ and carbenicillin 50 µg/ml (and re-dissolved in PBS (e.g. 1 ml) after harvesting. A temperature shock is applied by four rounds of freezing at −70° C. and thawing at 37° C. whereby the outer membrane of the bacteria is destroyed and the soluble periplasmic proteins including the scFvs are released into the supernatant. After elimination of intact cells and cell-debris by centrifugation, the supernatant containing the murine anti-human FAPalpha-scFvs is collected and used for further examination.

Screening of the isolated scFvs for membrane-proximal target binders is performed by flow cytometry on CHO cells expressing the human FAPalpha antigen as described in Example 6.1, the murine FAPalpha antigen as described in Example 6.3 and the mutated murine FAPalpha antigen with human membrane-distal epitopes as described in Example 6.5.

For flow cytometry $2.5 \times 10^5$ cells of the respective cell lines are incubated with 50 µl supernatant. The binding of the constructs is detected with an anti-His antibody (Penta-His Antibody, BSA free, Qiagen GmbH, Hilden, FRG) at 2 µg/ml in 50 µl PBS with 2% FCS. As a second step reagent an R-Phycoerythrin-conjugated affinity purified F(ab')2 fragment, goat anti-mouse IgG (Fc-gamma fragment specific), diluted 1:100 in 50 µl PBS with 2% FCS (Dianova, Hamburg, FRG) is used. The samples are measured on a FACSscan (BD biosciences, Heidelberg, FRG).

Only constructs which show binding to CHO cells expressing the human FAPalpha antigen and do not show binding to CHO cells expressing the murine FAPalpha antigen and also do not show binding to CHO cells expressing the mutated murine FAPalpha antigen with human membrane-distal epitopes are selected for further use.

6.10 Generation of Human/Humanized Equivalents of Non-human scFvs to Membrane-proximal Target Epitopes of Human FAPalpha The VH region of a murine anti-FAPalpha scFv to a membrane-proximal target epitope of human FAPalpha is aligned against human antibody germline amino acid sequences. The human antibody germline VH sequence is chosen which has the closest homology to the non-human VH and a direct alignment of the two amino acid sequences is performed. There are a number of framework residues of the non-human VH that differ from the human VH framework regions ("different framework positions"). Some of these residues may contribute to the binding and activity of the antibody to its target.

To construct a library that contains the murine CDRs and at every framework position that differs from the chosen human VH sequence both possible residues (the human and the maternal murine amino acid residue), degenerated oligonucleotides are synthesized. These oligonucleotides incorporate at the differing positions the human residue with a probability of 75% and the murine residue with a probability of 25%. For one human VH e.g. six of these oligonucleotides have to be synthesized that overlap in a terminal stretch of approximately 20 nucleotides. To this end every second primer is an antisense primer. Restriction sites within the oligonucleotides needed for later cloning are deleted.

These primers may have a length of 60 to 90 nucleotides, depending on the number of primers that are needed to span over the whole V sequence.

These e.g. six primers are mixed in equal amounts (e.g. 1 µl of each primer (primer stocks 20 to 100 µM) to a 20 µl PCR reaction) and added to a PCR mix consisting of PCR buffer, nucleotides and Taq polymerase. This mix is incubated at 94° C. for 3 minutes, 65° C. for 1 minute, 62° C. for 1 minute, 59° C. for 1 minute, 56° C. for 1 minute, 52° C. for 1 minute, 50° C. for 1 minute and at 72° C. for 10 minutes in a PCR cycler. Subsequently the product is run in an agarose gel electrophoresis and the product of a size from 200 to 400 base pairs isolated from the gel according to standard methods.

This PCR product is then used as a template for a standard PCR reaction using primers that incorporate suitable N-terminal and C-terminal cloning restriction sites. The DNA fragment of the correct size (for a VH approximately 350 nucleotides) is isolated by agarose gel electrophoresis according to standard methods. In this way sufficient VH DNA fragment is amplified. This VH fragment is now a pool of VH fragments that have each one a different amount of human and murine residues at the respective differing framework positions (pool of humanized VH). The same procedure is performed for the VL region of the murine anti-FAPalpha scFv to a membrane-proximal target epitope of human FAPalpha (pool of humanized VL). The pool of humanized VH is then combined with the pool of humanized VL in the phage display vector pComb3H5Bhis to form a library of functional scFvs from which—after display on filamentous phage—anti-FAPalpha binders to membrane-proximal target epitopes of human FAPalpha are selected, screened, identified and confirmed as described above for the parental non-human (murine) anti-FAPalpha scFv. Single clones are then analyzed for favorable properties and amino acid sequence. Those scFvs, which are closest in amino acid sequence homology to human germline V-segments, are preferred.

Human/humanized anti-FAPalpha scFvs to membrane-proximal target epitopes of human FAPalpha are converted into recombinant bispecific single chain antibodies and further characterized as follows.

6.11 Generation of I2C-based Bispecific Single Chain Antibodies Directed at Membrane-proximal Target Epitopes of Human FAPalpha Anti-FAPalpha scFvs to membrane-proximal target epitopes of human FAPalpha with favorable properties and amino acid sequence are converted into recombinant bispecific single chain antibodies by joining them via a $Gly_4Ser_1$-linker with the CD3 specific scFv 120 (SEQ ID NO: 185) to result in constructs with the domain arrangement $VH_{FAPalpha}$-$(Gly_4Ser_1)_3$-$VL_{FAPalpha}$-$Ser_1Gly_4Ser_1$-$VH_{CD3}$-$(Gly_4Ser_1)_3$-$VL_{cD3}$.

I2C-based bispecific single chain antibodies directed at membrane-proximal target epitopes of human FAPalpha were designed as set out in the following Table 5:

TABLE 5

Formats of I2C-based bispecific single chain antibodies directed at membrane-proximal target epitopes of human FAPalpha

| SEQ ID (nucl/prot) | Formats of protein constructs (N → C) |
|---|---|
| 820/819 | FA19D12HLxI2CHL |
| 806/805 | FA20H3HLxI2CHL |
| 750/749 | FA22A9HLxI2CHL |
| 764/763 | FA22C11HLxI2CHL |
| 834/833 | FA19D9HLxI2CHL |
| 778/777 | FA22D8HLxI2CHL |
| 792/791 | FA22E8HLxI2CHL |

Alternatively further constructs with different domain arrangements can be generated according to standard protocols. For expression in CHO cells the coding sequences of (i) an N-terminal immunoglobulin heavy chain leader comprising a start codon embedded within a Kozak consensus sequence and (ii) a C-terminal His6-tag followed by a stop codon are both attached in frame to the nucleotide sequence encoding the bispecific single chain antibodies prior to insertion of the resulting DNA-fragment as obtained by gene synthesis into the multiple cloning site of the expression vector pEF-DHFR (Raum et al. Cancer Immunol Immunother 50 (2001) 141-150). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

6.12 Expression and Purification of Bispecific Single Chain Antibody Molecules Directed at Membrane-proximal Target Epitopes of Human FAPalpha Bispecific single chain antibody molecules are expressed in Chinese hamster ovary cells (CHO). Eukaryotic protein expression in DHFR deficient CHO cells is performed as described by Kaufmann R. J. (1990) Methods Enzymol. 185, 537-566. Gene amplification of the constructs is induced by addition of increasing concentrations of MTX up to final concentrations of 20 nM MTX. After two passages of stationary culture cell culture supernatant is collected and used in the subsequent experiments. To generate supernatant for purification after two passages of stationary culture the cells are grown in roller bottles with nucleoside-free HyQ PF CHO liquid soy medium (with 4.0 mM L-Glutamine with 0.1% Pluronic F-68; HyClone) for 7 days before harvest. The cells are removed by centrifugation and the supernatant containing the expressed protein is stored at −20° C. Alternatively, constructs are transiently expressed in HEK 293 cells. Transfection is performed with 293fectin reagent (Invitrogen, #12347-019) according to the manufacturer's protocol. Furthermore the constructs are alternatively expressed in transiently transfected DHFR deficient CHO cells using for example FuGENE® HD Transfection Reagent (Roche Diagnostics GmbH, Cat. No. 04709691001) according to the manufacturer's protocol.

Äkta® Explorer System (GE Health Systems) and Unicorn® Software are used for chromatography. Immobilized metal affinity chromatography ("IMAC") is performed using a Fractogel EMD Chelate® (Merck) which is loaded with $ZnCl_2$ according to the protocol provided by the manufacturer. The column is equilibrated with buffer A (20 mM sodium phosphate buffer pH 7.2, 0.1 M NaCl) and the cell culture supernatant (500 ml) is applied to the column (10 ml) at a flow rate of 3 ml/min. The column is washed with buffer A to remove unbound sample. Bound protein is eluted using a two step gradient of buffer B (20 mM sodium phosphate buffer pH 7.2, 0.1 M NaCl, 0.5 M Imidazole) according to the following procedure:

Step 1: 20% buffer B in 6 column volumes
Step 2: 100% buffer B in 6 column volumes Eluted protein fractions from step 2 are pooled for further purification. All chemicals are of research grade and purchased from Sigma (Deisenhofen) or Merck (Darmstadt).

Gel filtration chromatography is performed on a HiLoad 16/60 Superdex 200 prep grade column (GE/Amersham) equilibrated with Equi-buffer (25 mM Citrate, 200 mM Lysine, 5% Glycerol, pH 7.2). Eluted protein samples (flow rate 1 ml/min) are subjected to standard SDS-PAGE and Western Blot for detection. Prior to purification, the column is calibrated for molecular weight determination (molecular weight marker kit, Sigma MW GF-200). Protein concentrations are determined using OD280 nm.

Purified bispecific single chain antibody protein is analyzed in SDS PAGE under reducing conditions performed with pre-cast 4-12% Bis Tris gels (Invitrogen). Sample preparation and application are performed according to the protocol provided by the manufacturer. The molecular weight is determined with MultiMark protein standard (Invitrogen). The gel is stained with colloidal Coomassie (Invitrogen protocol). The purity of the isolated protein is typically >95% as determined by SDS-PAGE.

The bispecific single chain antibody has a molecular weight of about 52 kDa under native conditions as determined by gel filtration in PBS.

Western Blot is performed using an Optitran® BA-S83 membrane and the Invitrogen Blot Module according to the protocol provided by the manufacturer. The antibody used is directed against the His Tag (Penta His, Qiagen) and a Goat-anti-mouse Ig labeled with alkaline phosphatase (AP) (Sigma) is used as second step reagent, and BCIP/NBT (Sigma) as substrate. A band detected at 52 kD corresponds to purified bispecific single chain antibodies.

6.13 Flow Cytometric Binding Analysis of Bispecific Antibodies Directed at Membrane-proximal Target Epitopes of Human FAPalpha In order to test the functionality of bispecific antibody constructs regarding the capability to bind to CD3 and to human FAPalpha, respectively, a FACS analysis is performed. For this purpose CHO cells transfected with human FAPalpha as described in Example 6.1 and the human CD3 positive T cell leukemia cell line HPB-ALL (DSMZ, Braunschweig, ACC483) are used. 200,000 cells of the respective cell lines are incubated for 30 min on ice with 50 µl of cell culture supernatant of transfected cells expressing the bispecific antibody constructs. The cells are washed twice in PBS with 2% FCS and binding of the construct is detected with a murine Penta His antibody (Qiagen; diluted 1:20 in 50 µl PBS with 2% FCS). After washing, bound anti His antibodies are detected with an Fc gamma-specific antibody (Dianova) conjugated to phycoerythrin, diluted 1:100 in PBS with 2% FCS. Supernatant of untransfected cells is used as a negative control.

Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

Only those constructs that show bispecific binding to human CD3 as well as to human FAPalpha are selected for further use.

Figure 11A:
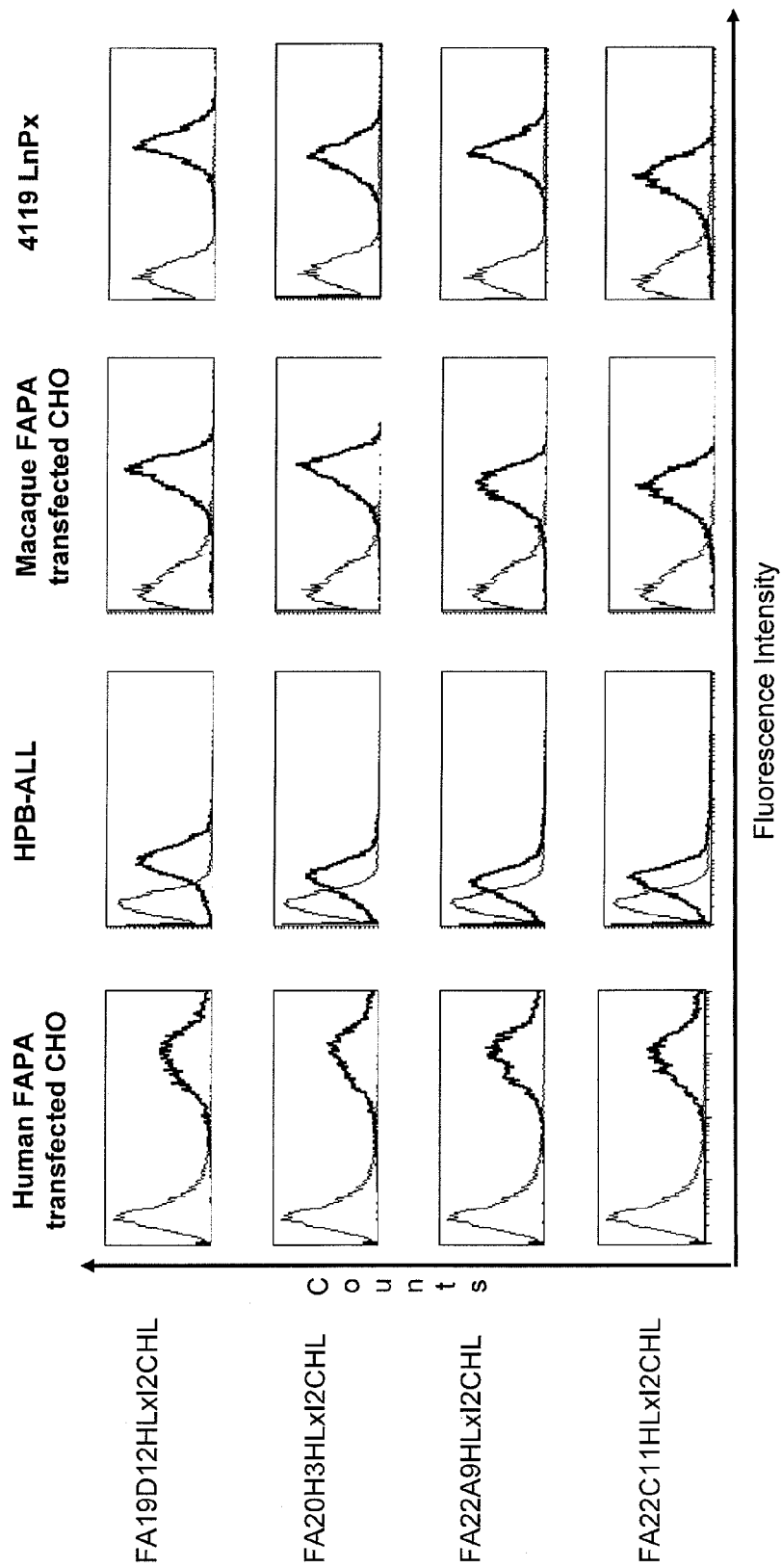
Figure 11B:
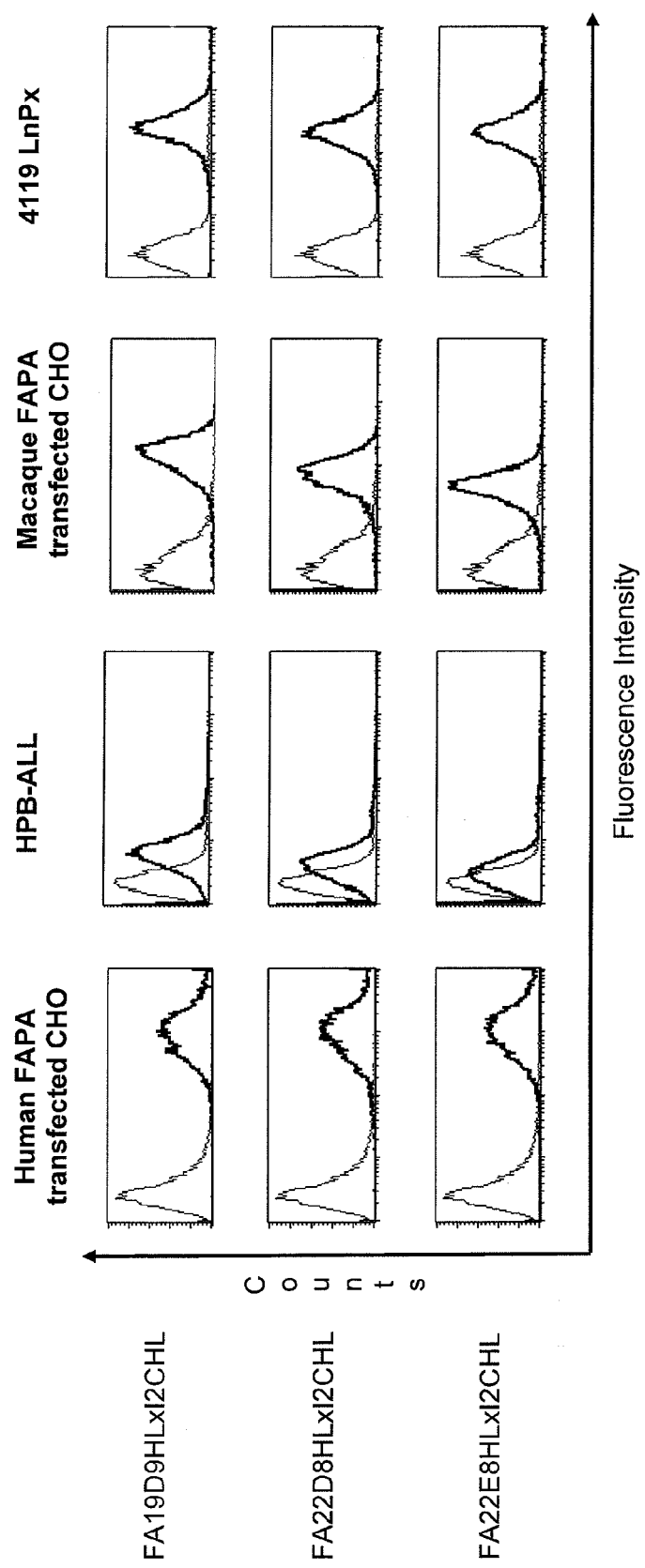

The bispecific binding of the single chain molecules listed above was clearly detectable as shown in FIG. 11. In the FACS analysis all constructs showed binding to human CD3 and human FAPA compared to the negative control.

6.14 Bioactivity of Bispecific Antibodies Directed at Membrane-proximal Target Epitopes of Human FAPalpha Bioactivity of generated bispecific single chain antibodies is analyzed by chromium 51 ($^{51}Cr$) release in vitro cytotoxicity assays using the CHO cells transfected with human FAPalpha described in Example 6.1. To confirm that significant bioactivity is only recruited by binding to membrane-proximal target epitopes of human FAPalpha—in addition— CHO cells expressing the murine FAPalpha antigen as described in Example 6.3 and CHO cells expressing the mutated human FAPalpha antigen with murine membrane-distal epitopes as described in Example 6.4 are used. As effector cells stimulated human CD4/CD56 depleted PBMC are used.

Stimulated human PBMC are obtained as follows:

A Petri dish (145 mm diameter, Greiner bio-one GmbH, Kremsmünster) is coated with a commercially available anti-CD3 specific antibody (e.g. OKT3, Orthoclone) in a final concentration of 1 µg/ml for 1 hour at 37° C. Unbound protein is removed by one washing step with PBS. The fresh PBMC are isolated from peripheral blood (30-50 ml human blood) by Ficoll gradient centrifugation according to standard protocols. $3\text{-}5 \times 10^7$ PBMC are added to the precoated petri dish in 120 ml of RPMI 1640 with stabilized glutamine/10% FCS/IL-2 20 U/ml (Proleukin, Chiron) and stimulated for 2 days.

On the third day the cells are collected and washed once with RPMI 1640. IL 2 is added to a final concentration of 20 U/ml and the cells are cultivated again for one day in the same cell culture medium as above.

By depletion of CD4+ T cells and CD56+ NK cells according to standard protocols CD8+ cytotoxic T lymphocytes (CTLs) are enriched.

Target cells are washed twice with PBS and labeled with 11.1 MBq $^{51}$Cr in a final volume of 100 µl RPMI with 50% FCS for 60 minutes at 37° C. Subsequently the labeled target cells are washed 3 times with 5 ml RPMI and then used in the cytotoxicity assay. The assay is performed in a 96 well plate in a total volume of 250 µl supplemented RPMI (as above) with an E:T ratio of 10:1. Supernatant of cells expressing the bispecific single chain antibody molecules in a final concentration of 6.6% and 14 threefold dilutions thereof are applied. The assay time is 18 hours. Cytotoxicity is measured as relative values of released chromium in the supernatant related to the difference of maximum lysis (addition of Triton-X) and spontaneous lysis (without effector cells). All measurements are done in quadruplicates. Measurement of chromium activity in the supernatants is performed with a Wizard® 3" gammacounter (Perkin Elmer Life Sciences GmbH, Koln, Germany). Analysis of the experimental data is performed with Prism 4 for Windows® (version 4.02, GraphPad Software Inc., San Diego, Calif., USA). Sigmoidal dose response curves typically have $R^2$ values >0.90 as determined by the software.

Only those constructs showing potent recruitment of cytotoxic activity of effector T cells against target cells positive for FAPalpha are selected for further use. As shown in FIG. 12 all of the generated bispecific antibodies directed at membrane-proximal target epitopes of human FAPalpha demonstrated cytotoxic activity against human FAPA positive target cells and target cells positive for the mutated human FAPalpha antigen with murine membrane-distal epitopes elicited by stimulated human CD4/CD56 depleted PBMC but did not recruit significant cytotoxic activity against murine FAPalpha positive target cells. Thereby specific recruitment of cytotoxic activity via binding to membrane-proximal target epitopes of human FAPalpha was confirmed.

6.15 Generation of CHO Cells Expressing Macaque FAPalpha

The cDNA sequence of macaque FAPalpha is obtained by a set of four PCRs on cDNA from macaque monkey skin prepared according to standard protocols. The following reaction conditions: 1 cycle at 94° C. for 3 minutes followed by 40 cycles with 94° C. for 0.5 minutes, 56° C. for 0.5 minutes and 72° C. for 3 minutes followed by a terminal cycle of 72° C. for 3 minutes and the following primers are used:

```
1. forward primer:
    5'-cagcttccaactacaaagacagac-3'        SEQ ID
                                          NO: 376
   reverse primer:
    5'-tttcctcttcataaacccagtctgg-3'       SEQ ID
                                          NO: 377

2. forward primer:
    5'-ttgaaacaaagaccaggagatccacc-3'      SEQ ID
                                          NO: 378
   reverse primer:
    5'-agatggcaagtaacacacttcttgc-3'       SEQ ID
                                          NO: 379

3. forward primer:
    5'-gaagaaacatctacagaattagcattgg-3'    SEQ ID
                                          NO: 380
```

```
-continued
   reverse primer:
    5'-cacatttgaaaagaccagttccagatgc-3'    SEQ ID
                                          NO: 381

4. forward primer:
    5'-agattacagctgtcagaaaattcatagaaatgg-3' SEQ ID
                                          NO: 382
   reverse primer:
    5'-atataaggttttcagattctgatacaggc-3'   SEQ ID
                                          NO: 383
```

These PCRs generate four overlapping fragments, which are isolated and sequenced according to standard protocols using the PCR primers, and thereby provided the cDNA sequence coding macaque FAPalpha. To generate a construct for expression of macaque FAPalpha a cDNA fragment is obtained by gene synthesis according to standard protocols (the cDNA and amino acid sequence of the construct is listed under SEQ ID Nos 384 and 385). This construct contains the complete coding sequence of macaque FAPalpha followed by a stop codon. The gene synthesis fragment is also designed as to contain a Kozak site for eukaryotic expression of the construct and restriction sites at the beginning and the end of the fragment containing the cDNA. The introduced restriction sites, EcoRI at the 5' end and SalI at the 3' end, are utilised in the following cloning procedures. The gene synthesis fragment is cloned via EcoRI and SalI into a plasmid designated pEF-DHFR (pEF-DHFR is described in Raum et al. Cancer Immunol Immunother 50 (2001) 141-150) following standard protocols. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

6.16 Flow Cytometric Analysis of Cross-species Specificity of Bispecific Antibodies Directed at Membrane-proximal Target Epitopes of Human FAPalpha In order to test the cross-species specificity of bispecific antibodies directed at membrane-proximal target epitopes of human FAPalpha the capability of the constructs to bind to macaque FAPalpha and macaque CD3, respectively, is investigated by FACS analysis. For this purpose the macaque FAPalpha transfected CHO cells as described in example 6.15 and the macaque T cell line 4119LnPx (kindly provided by Prof Fickenscher, Hygiene Institute, Virology, Erlangen-Nuernberg; published in Knappe A, et al., and Fickenscher H., Blood 2000, 95, 3256-61) are used. 200,000 cells of the respective cell lines are incubated for 30 min on ice with 50 µl of cell culture supernatant of transfected cells expressing the cross-species specific bispecific antibody constructs. The cells are washed twice in PBS with 2% FCS and binding of the construct is detected with a murine Penta His antibody (Qiagen; diluted 1:20 in 50 µl PBS with 2% FCS). After washing, bound anti His antibodies are detected with an Fc gamma-specific antibody (Dianova) conjugated to phycoerythrin, diluted 1:100 in PBS with 2% FCS. Supernatant of untransfected cells is used as a negative control.

Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

The cross-species specific binding of the single chain molecules listed above was clearly detectable as shown in FIG. 11. In the FACS analysis all constructs showed binding to macaque CD3 and macaque FAPA compared to the negative control.

7. Generation of Bispecific Single Chain Antibodies Directed at Membrane-proximal Target Epitopes of Human c-MET 7.1 Generation of CHO Cells Expressing Human c-MET The coding sequence of human c-MET as published in GenBank (Accession number NM_000245) is obtained by gene synthesis according to standard protocols. The gene synthesis fragment is designed as to contain first a Kozak site for eukaryotic expression of the construct followed by the coding sequence of the human c-MET protein and a stop codon (the cDNA and amino acid sequence of the construct is listed under SEQ ID Nos 368 and 387). The gene synthesis fragment is also designed as to introduce restriction sites at the beginning and at the end of the fragment. The introduced restriction sites, EcoRI at the 5' end and SalI at the 3' end, are utilized in the following cloning procedures. Internal restriction sites are removed by silent mutation of the coding sequence in the gene synthesis fragment. The gene synthesis fragment is cloned via EcoRI and SalI into a plasmid designated pEF-DHFR (pEF-DHFR is described in Raum et al. Cancer Immunol Immunother 50 (2001) 141-150) following standard protocols. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

7.2 Generation of a Soluble Human c-MET Fusion Protein

The modified coding sequence of human c-MET as described in Example 7.1 is used for the construction of an artificial cDNA sequence encoding a soluble fusion protein of human c-MET and murine IgG1 Fc. To generate a construct for expression of the soluble human c-MET fusion protein a cDNA fragment is obtained by gene synthesis according to standard protocols (the cDNA and amino acid sequence of the construct is listed under SEQ ID Nos 388 and 389). The gene synthesis fragment is designed as to contain first a Kozak site for eukaryotic expression of the construct followed by the coding sequence of the human c-MET protein from amino acid 1 to 932 corresponding to the signal peptide and extracellular domains of human c-MET, followed in frame by the coding sequence of an artificial $Ser_1$-$Gly_4$-$Ser_1$-linker, followed in frame by the coding sequence of the hinge region and Fc gamma portion of murine IgG1, followed in frame by the coding sequence of a 6 histidine tag and a stop codon. The gene synthesis fragment is also designed as to introduce restriction sites at the beginning and at the end of the fragment. The introduced restriction sites, EcoRI at the 5' end and SalI at the 3' end, are utilized in the following cloning procedures. The gene synthesis fragment is cloned via EcoRI and SalI into a plasmid designated pEF-DHFR (pEF-DHFR is described in Raum et al. Cancer Immunol Immunother 50 (2001) 141-150) following standard protocols. The aforementioned procedures are all carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX. After two passages of stationary culture the cells are grown in roller bottles with nucleoside-free HyQ PF CHO liquid soy medium (with 4.0 mM L-Glutamine with 0.1% Pluronic F—68; HyClone) for 7 days before harvest. The cells are removed by centrifugation and the supernatant containing the expressed protein is stored at −20° C. Alternatively a clone of the expression plasmid with sequence-verified nucleotide sequence is used for transfection and protein expression in the FreeStyle 293 Expression System (Invitrogen GmbH, Karlsruhe, Germany) according to the manufacturer's protocol. Supernatant containing the expressed protein is obtained, cells are removed by centrifugation and the supernatant is stored at −20° C.

For purification of the soluble human c-MET fusion protein a goat anti-mouse Fc affinity column is prepared according to standard protocols using a commercially available affinity purified goat anti-mouse IgG Fc fragment specific antibody with minimal cross-reaction to human, bovine and horse serum proteins (Jackson ImmunoResearch Europe Ltd.). Using this affinity column the fusion protein is isolated out of cell culture supernatant on an Äkta Explorer System (GE Amersham) and eluted by citric acid. The eluate is neutralized and concentrated.

7.3 Generation of CHO Cells Expressing Murine c-MET

The sequence of murine c-MET (NM_008591 *Mus musculus* met proto-oncogene (Met), mRNA, National Center for Biotechnology Information, http://www.ncbi.nlm.nih.gov/entrez) is used to obtain a synthetic cDNA molecule by gene synthesis according to standard protocols. The gene synthesis fragment is designed as to contain the coding sequence of an immunoglobulin heavy chain leader comprising a start codon embedded within a Kozak consensus sequence, followed in frame by the coding sequence of a FLAG tag, followed in frame by the complete coding sequence of the mature murine c-MET (the cDNA and amino acid sequence of the construct is listed under SEQ ID Nos 390 and 391). The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150) Internal restriction sites are removed by silent mutation of the coding sequence in the gene synthesis fragment. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

7.4 Generation of CHO Cells Expressing a Mutated Human c-MET Antigen with Murine Membrane-distal Epitopes The coding sequence of a mutated human c-MET antigen with murine membrane-distal epitopes is obtained by gene synthesis according to standard protocols. The gene synthesis fragment is designed as to contain the coding sequence of an immunoglobulin heavy chain leader comprising a start codon embedded within a Kozak consensus sequence, followed in frame by the coding sequence of a FLAG tag, followed in frame by the coding sequence of the alpha-chain of the sema domain of mature murine c-MET followed in frame by human c-MET from the beta-chain of the sema domain to the stop codon (the cDNA and amino acid sequence of the construct is listed under SEQ ID Nos 392 and 393). The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150). Internal restriction sites are removed by silent mutation of the coding sequence in the gene synthesis fragment. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

7.5 Generation of CHO Cells Expressing a Mutated Murine c-MET Antigen with Human Membrane-distal Epitopes The coding sequence of a mutated murine c-MET antigen with human membrane-distal epitopes is obtained by gene synthesis according to standard protocols. The gene synthesis fragment is designed as to contain the coding sequence of an immunoglobulin heavy chain leader comprising a start codon embedded within a Kozak consensus sequence, followed in frame by the coding sequence of a FLAG tag, followed in frame by the coding sequence of the alpha-chain of the sema domain of mature human c-MET, followed in frame by murine c-MET from the beta-chain of the sema domain to the stop codon (the cDNA and amino acid sequence of the construct is listed under SEQ ID Nos 394 and 395). The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150). Internal restriction sites are removed by silent mutation of the coding sequence in the gene synthesis fragment. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

7.6 Immunization of Mice Using a Soluble Human c-MET Fusion Protein

Twelve weeks old F1 mice from BALB/c×C57BL/6 crossings are immunized with the soluble human c-MET fusion protein as described in Example 7.2. To this end for each animal 40 µg of the soluble human c-MET fusion protein are mixed with 10 nmol of a thioate-modified CpG-Oligonucleotide (5'-tccatgacgttcctgatgct-3') in 300 µl PBS and are injected intraperitoneally. Mice receive booster immunizations after 21, 42 and optionally 63 days in the same way. Ten days after the first booster immunization, blood samples are taken and antibody serum titers against human c-MET are tested by flow cytometry according to standard protocols. To this end 200,000 cells of the human c-MET transfected CHO cells as described in Example 7.17 are incubated for 30 min on ice with 50 µl of serum of the immunized animals diluted 1:1000 in PBS with 2% FCS. The cells are washed twice in PBS with 2% FCS and binding of serum antibodies is detected with an mouse Fc gamma-specific antibody (Dianova) conjugated to phycoerythrin, diluted 1:100 in PBS with 2% FCS. Serum of the animals obtained prior to immunization is used as a negative control. Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

Animals demonstrating significant serum reactivity against human c-MET as determined by the FACS analysis are used in the subsequent experiment.

7.7 Generation of an Immune Murine Antibody scFv Library: Construction of a Combinatorial Antibody Library and Phage Display Three days after the last booster immunization spleen cells of reactive animals are harvested for the preparation of total RNA according to standard protocols.

A library of murine immunoglobulin (Ig) light chain (kappa) variable region (VK) and Ig heavy chain variable region (VH) DNA-fragments is constructed by RT-PCR on murine spleen RNA using VK- and VH specific primers. cDNA is synthesized according to standard protocols, see example 2.7.

450 ng of the kappa light chain fragments (SacI-SpeI digested) are ligated with 1400 ng of the phagemid pComb3H5Bhis (SacI-SpeI digested; large fragment). The resulting combinatorial antibody library is then transformed into 300 µl of electrocompetent *Escherichia coli* XL1 Blue cells by electroporation (2.5 kV, 0.2 cm gap cuvette, 25 µFD, 200 Ohm, Biorad gene-pulser) resulting in a library size of more than $10^7$ independent clones. After one hour of phenotype expression, positive transformants are selected for carbenicillin resistance encoded by the pComb3H5BHis vector in 100 ml of liquid super broth (SB)-culture over night. Cells are then harvested by centrifugation and plasmid preparation is carried out using a commercially available plasmid preparation kit (Qiagen).

2800 ng of this plasmid-DNA containing the VK-library (XhoI-BstEII digested; large fragment) are ligated with 900 ng of the heavy chain V-fragments (XhoI-BstEII digested) and again transformed into two 300 µl aliquots of electrocompetent *E. coli* XL1 Blue cells by electroporation (2.5 kV, 0.2 cm gap cuvette, 25 µFD, 200 Ohm) resulting in a total VH-VK scFv (single chain variable fragment) library size of more than $10^7$ independent clones.

After phenotype expression and slow adaptation to carbenicillin, the *E. coli* cells containing the antibody library are transferred into SB-Carbenicillin (SB with 50 µg/mL carbenicillin) selection medium. The *E. coli* cells containing the antibody library are then infected with an infectious dose of $10^{12}$ particles of helper phage VCSM 1 3 resulting in the production and secretion of filamentous M13 phage, wherein each phage particle contains single stranded pComb3H5BHis-DNA encoding a murine scFv-fragment and displays the corresponding scFv-protein as a translational fusion to phage coat protein III. This pool of phages displaying the antibody library is later used for the selection of antigen binding entities.

7.8 Phage Display Based Selection of Membrane-proximal Target Binders on CHO Cells Expressing the Mutated Human c-MET Antigen with Murine Membrane-distal Epitopes The phage library carrying the cloned scFv-repertoire is harvested from the respective culture supernatant by PEG8000/NaCl precipitation and centrifugation. Approximately $10^{11}$ to $10^{12}$ scFv phage particles are resuspended in 0.4 ml of PBS/0.1% BSA and incubated with $10^5$ to $10^7$ CHO cells expressing the mutated human c-MET antigen with murine membrane-distal epitopes as described in example 7.17 for 1 hour on ice under slow agitation. These CHO cells are grown beforehand, harvested by centrifugation, washed in PBS and resuspended in PBS/1% FCS (containing Na Azide). scFv phage which do not specifically bind to the CHO cells are eliminated by up to five washing steps with PBS/1% FCS (containing Na Azide). After washing, binding entities are eluted from the cells by resuspending the cells in HCl-glycine pH 2.2 (10 min incubation with subsequent vortexing) and after neutralization with 2 M Tris pH 12, the eluate is used for infection of a fresh uninfected E. coli XL1 Blue culture (OD600>0.5). The E. coli culture containing E. coli cells successfully transduced with a phagemid copy, encoding a murine scFv-fragment, are again selected for carbenicillin resistance and subsequently infected with VCMS13 helper phage to start the second round of antibody display and in vitro selection. Typically a total of 4 to 5 rounds of selections are carried out.

7.9 Screening for Membrane-proximal Target Binders on CHO Cells Expressing the Human c-MET Antigen, the Murine c-MET Antigen, the Mutated Human c-MET Antigen with Murine Membrane-distal Epitopes and the Mutated Murine c-MET Antigen with Human Membrane-distal Epitopes Plasmid DNA corresponding to 4 and 5 rounds of panning is isolated from E. coli cultures after selection. For the production of soluble scFv-protein, VH-VL-DNA fragments are excised from the plasmids (XhoI-SpeI). These fragments are cloned via the same restriction sites in the plasmid pComb3H5BFlag/His differing from the original pComb3H5BHis in that the expression construct (e.g. scFv) includes a Flag-tag (TGDYKDDDDK) between the scFv and the His6-tag and the additional phage proteins are deleted. After ligation, each pool (different rounds of panning) of plasmid DNA is transformed into 100 µl heat shock competent E. coli TG1 or XLI blue and plated onto carbenicillin LB-agar. Single colonies are picked into 100 µl of LB carb (LB with 50 µg/ml carbenicillin).

After induction with 1 mM IPTG E. coli transformed with pComb3H5BFlag/His containing a VL- and VH-segment produce soluble scFv in sufficient amounts. Due to a suitable signal sequence, the scFv is exported into the periplasma where it folds into a functional conformation.

Single E. coli bacterial colonies from the transformation plates are picked for periplasmic small scale preparations and grown in SB-medium (e.g. 10 ml) supplemented with 20 mM $MgCl_2$ and carbenicillin 50 µg/ml (and re-dissolved in PBS (e.g. 1 ml) after harvesting. A temperature shock is applied by four rounds of freezing at $-70°$ C. and thawing at $37°$ C. whereby the outer membrane of the bacteria is destroyed and the soluble periplasmic proteins including the scFvs are released into the supernatant. After elimination of intact cells and cell-debris by centrifugation, the supernatant containing the murine anti-human c-MET-scFvs is collected and used for further examination.

Screening of the isolated scFvs for membrane-proximal target binders is performed by flow cytometry on CHO cells expressing the human c-MET antigen as described in Example 7.17, the murine c-MET antigen as described in Example 7.17, the mutated human c-MET antigen with murine membrane-distal epitopes as described in Example 7.17 and the mutated murine c-MET antigen with human membrane-distal epitopes as described in Example 7.17.

For flow cytometry $2.5 \times 10^5$ cells of the respective cell lines are incubated with 50 µl supernatant. The binding of the constructs is detected with an anti-His antibody (Penta-His Antibody, BSA free, Qiagen GmbH, Hilden, FRG) at 2 µg/ml in 50 µl PBS with 2% FCS. As a second step reagent a R-Phycoerythrin-conjugated affinity purified F(ab')2 fragment, goat anti-mouse IgG (Fc-gamma fragment specific), diluted 1:100 in 50 µl PBS with 2% FCS (Dianova, Hamburg, FRG) is used. The samples are measured on a FACSscan (BD biosciences, Heidelberg, FRG).

Only constructs which show binding to CHO cells expressing the human c-MET antigen and show binding to CHO cells expressing the mutated human c-MET antigen with murine membrane-distal epitopes and do not show binding to CHO cells expressing the murine c-MET antigen and also do not show binding to CHO cells expressing the mutated murine c-MET antigen with human membrane-distal epitopes are selected for further use.

scFv specific for membrane proximal epitopes of human cMET were generated as described above and designated as set out in the following Table 6:

TABLE 6

| Designation of single chain antibody fragments | |
|---|---|
| SEQ ID (nucl/prot) | Designation |
| 734/733 | ME06F2HL |
| 720/719 | ME06E10HL |
| 706/705 | ME06D2HL |
| 692/691 | ME06D1HL |
| 664/663 | ME06C7HL |
| 650/649 | ME06C6HL |
| 678/677 | ME06B7HL |
| 636/635 | ME05F6HL |
| 622/621 | ME05B7HL |
| 608/607 | ME99B1HL |
| 594/593 | ME75H6HL |

Membrane-proximal target binding of the single chain molecules listed above was clearly detectable as shown in FIG. 16. In the FACS analysis all constructs showed binding to the human c-MET antigen and showed binding to the mutated human c-MET antigen with murine membrane-distal epitopes and did not show binding to the murine c-MET antigen and did also not show binding to the mutated murine c-MET antigen with human membrane-distal epitopes as compared to the negative control.

7.10 Generation of Human/Humanized Equivalents of Non-human scFvs to Membrane-proximal Target Epitopes of Human c-Met The VH region of a murine anti-c-MET scFv to a membrane-proximal target epitope of human c-MET is aligned against human antibody germline amino acid sequences. The human antibody germline VH sequence is chosen which has the closest homology to the non-human VH and a direct alignment of the two amino acid sequences is performed. There are a number of framework residues of the non-human VH that differ from the human VH framework regions ("different framework positions"). Some of these residues may contribute to the binding and activity of the antibody to its target.

To construct a library that contains the murine CDRs and at every framework position that differs from the chosen human VH sequence both possible residues (the human and the maternal murine amino acid residue), degenerated oligonucleotides are synthesized. These oligonucleotides incorporate at the differing positions the human residue with a probability of 75% and the murine residue with a probability of 25%. For one human VH e.g. six of these oligonucleotides have to be synthesized that overlap in a terminal stretch of approximately 20 nucleotides. To this end every second primer is an antisense primer. Restriction sites within the oligonucleotides needed for later cloning are deleted.

These primers may have a length of 60 to 90 nucleotides, depending on the number of primers that are needed to span over the whole V sequence.

These e.g. six primers are mixed in equal amounts (e.g. 1 μl of each primer (primer stocks 20 to 100 μM) to a 20 μl PCR reaction) and added to a PCR mix consisting of PCR buffer, nucleotides and Taq polymerase. This mix is incubated at 94° C. for 3 minutes, 65° C. for 1 minute, 62° C. for 1 minute, 59° C. for 1 minute, 56° C. for 1 minute, 52° C. for 1 minute, 50° C. for 1 minute and at 72° C. for 10 minutes in a PCR cycler. Subsequently the product is run in an agarose gel electrophoresis and the product of a size from 200 to 400 base pairs isolated from the gel according to standard methods.

This PCR product is then used as a template for a standard PCR reaction using primers that incorporate suitable N-terminal and C-terminal cloning restriction sites. The DNA fragment of the correct size (for a VH approximately 350 nucleotides) is isolated by agarose gel electrophoresis according to standard methods. In this way sufficient VH DNA fragment is amplified. This VH fragment is now a pool of VH fragments that have each one a different amount of human and murine residues at the respective differing framework positions (pool of humanized VH). The same procedure is performed for the VL region of the murine anti-c-MET scFv to a membrane-proximal target epitope of human c-MET (pool of humanized VL).

The pool of humanized VH is then combined with the pool of humanized VL in the phage display vector pComb3H5Bhis to form a library of functional scFvs from which—after display on filamentous phage—anti-c-MET binders to membrane-proximal target epitopes of human c-MET are selected, screened, identified and confirmed as described above for the parental non-human (murine) anti-c-MET scFv. Single clones are then analyzed for favorable properties and amino acid sequence. Those scFvs, which are closest in amino acid sequence homology to human germline V-segments, are preferred.

Human/humanized anti-c-MET scFvs to membrane-proximal target epitopes of human c-MET are converted into recombinant bispecific single chain antibodies and further characterized as follows.

7.11 Generation of I2C-based Bispecific Single Chain Antibodies Directed at Membrane-proximal Target Epitopes of Human c-MET Anti-c-MET scFvs to membrane-proximal target epitopes of human c-MET with favorable properties and amino acid sequence are converted into recombinant bispecific single chain antibodies by joining them via a $Gly_4Ser_1$-linker with the CD3 specific scFv 120 (SEQ ID NO: 185) to result in constructs with the domain arrangement $VH_{c\text{-}MET}$-$(Gly_4Ser_1)_3$-$VL_{c\text{-}MET}$-$Ser_1Gly_4Ser_1$-$VH_{CD3}$-$(Gly_4Ser_1)_3$-$VL_{CD3}$.

I2C-based bispecific single chain antibodies directed at membrane-proximal target epitopes of human c-MET were designed as set out in the following Table 7:

TABLE 7

Formats of I2C-based bispecific single chain antibodies directed at membrane-proximal target epitopes of human c-MET

| SEQ ID (nucl/prot) | Formats of protein constructs (N → C) |
|---|---|
| 512/511 | ME86H11HLxI2CHL |
| 526/525 | ME62A12HLxI2CHL |
| 540/539 | ME63F2HLxI2CHL |
| 554/553 | ME62D11HLxI2CHL |
| 568/567 | ME62C10HLxI2CHL |
| 582/581 | ME62A4HLxI2CHL |

Alternatively further constructs with different domain arrangements can be generated according to standard protocolls. For expression in CHO cells the coding sequences of (i) an N-terminal immunoglobulin heavy chain leader comprising a start codon embedded within a Kozak consensus sequence and (ii) a C-terminal His6-tag followed by a stop codon are both attached in frame to the nucleotide sequence encoding the bispecific single chain antibodies prior to insertion of the resulting DNA-fragment as obtained by gene synthesis into the multiple cloning site of the expression vector pEF-DHFR (Raum et al. Cancer Immunol Immunother 50 (2001) 141-150). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

7.12 Expression and Purification of Bispecific Single Chain Antibody Molecules Directed at Membrane-proximal Target Epitopes of Human c-MET Bispecific single chain antibody molecules are expressed in Chinese hamster ovary cells (CHO). Eukaryotic protein expression in DHFR deficient CHO cells is performed as described by Kaufmann R. J. (1990) Methods Enzymol. 185, 537-566. Gene amplification of the constructs is induced by addition of increasing concentrations of MTX up to final concentrations of 20 nM MTX. After two passages of stationary culture cell culture supernatant is collected and used in the subsequent experiments. To generate supernatant for purification after two passages of stationary culture the cells are grown in roller bottles with nucleoside-free HyQ PF CHO liquid soy medium (with 4.0 mM L-Glutamine with 0.1% Pluronic F-68; HyClone) for 7 days before harvest. The cells are removed by centrifugation and the supernatant containing the expressed protein is stored at −20° C. Alternatively, constructs are transiently expressed in HEK 293 cells. Transfection is performed with 293fectin reagent (Invitrogen, #12347-019) according to the manufacturer's protocol. Furthermore the constructs are alternatively expressed in transiently transfected DHFR deficient CHO cells using for example FuGENE® HD Transfection Reagent (Roche Diagnostics GmbH, Cat. No. 04709691001) according to the manufacturer's protocol.

Äkta® Explorer System (GE Health Systems) and Unicorn® Software are used for chromatography. Immobilized metal affinity chromatography ("IMAC") is performed using a Fractogel EMD Chelate® (Merck) which is loaded with $ZnCl_2$ according to the protocol provided by the manufacturer. The column is equilibrated with buffer A (20 mM sodium phosphate buffer pH 7.2, 0.1 M NaCl) and the cell culture supernatant (500 ml) is applied to the column (10 ml) at a flow rate of 3 ml/min. The column is washed with buffer A to remove unbound sample. Bound protein is eluted using a two step gradient of buffer B (20 mM sodium phosphate buffer pH 7.2, 0.1 M NaCl, 0.5 M Imidazole) according to the following procedure:

Step 1: 20% buffer B in 6 column volumes
Step 2: 100% buffer B in 6 column volumes Eluted protein fractions from step 2 are pooled for further purification. All chemicals are of research grade and purchased from Sigma (Deisenhofen) or Merck (Darmstadt).

Gel filtration chromatography is performed on a HiLoad 16/60 Superdex 200 prep grade column (GE/Amersham) equilibrated with Equi-buffer (25 mM Citrate, 200 mM Lysine, 5% Glycerol, pH 7.2). Eluted protein samples (flow rate 1 ml/min) are subjected to standard SDS-PAGE and Western Blot for detection. Prior to purification, the column is calibrated for molecular weight determination (molecular weight marker kit, Sigma MW GF-200). Protein concentrations are determined using OD280 nm.

Purified bispecific single chain antibody protein is analyzed in SDS PAGE under reducing conditions performed with pre-cast 4-12% Bis Tris gels (Invitrogen). Sample preparation and application are performed according to the protocol provided by the manufacturer. The molecular weight is determined with MultiMark protein standard (Invitrogen). The gel is stained with colloidal Coomassie (Invitrogen protocol). The purity of the isolated protein is typically >95% as determined by SDS-PAGE.

The bispecific single chain antibody has a molecular weight of about 52 kDa under native conditions as determined by gel filtration in PBS.

Western Blot is performed using an Optitran® BA-S83 membrane and the Invitrogen Blot Module according to the protocol provided by the manufacturer. The antibody used is directed against the His Tag (Penta His, Qiagen) and a Goat-anti-mouse Ig labeled with alkaline phosphatase (AP) (Sigma) is used as second step reagent, and BCIP/NBT (Sigma) as substrate. A band detected at 52 kD corresponds to purified bispecific single chain antibodies.

7.13 Flow Cytometric Binding Analysis of Bispecific Antibodies Directed at Membrane-proximal Target Epitopes of Human c-MET In order to test the functionality of bispecific antibody constructs regarding the capability to bind to CD3 and to membrane-proximal target epitopes of human c-MET, respectively, a FACS analysis is performed. For this purpose CHO cells transfected with human c-MET as described in Example 7.17 and the human CD3 positive T cell leukemia cell line HPB-ALL (DSMZ, Braunschweig, ACC483) are used. For confirmation of binding to membrane-proximal target epitopes of human c-MET—in addition—CHO cells expressing the murine c-MET antigen as described in Example 7.17, CHO cells expressing the mutated human c-MET antigen with murine membrane-distal epitopes as described in Example 7.17 and CHO cells expressing the mutated murine c-MET antigen with human membrane-distal epitopes as described in Example 7.17 are used. 200,000 cells of the respective cell lines are incubated for 30 min on ice with 50 µl of cell culture supernatant of transfected cells expressing the bispecific antibody constructs. The cells are washed twice in PBS with 2% FCS and binding of the construct is detected with a murine Penta His antibody (Qiagen; diluted 1:20 in 50 µl PBS with 2% FCS). After washing, bound anti His antibodies are detected with an Fc gamma-specific antibody (Dianova) conjugated to phycoerythrin, diluted 1:100 in PBS with 2% FCS. Supernatant of untransfected cells is used as a negative control.

Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

Only those constructs that show bispecific binding to human CD3 as well as to human c-MET and neither bind to the murine c-MET antigen nor to the mutated murine c-MET antigen with human membrane-distal epitopes are selected for further use.

Figure 13A:
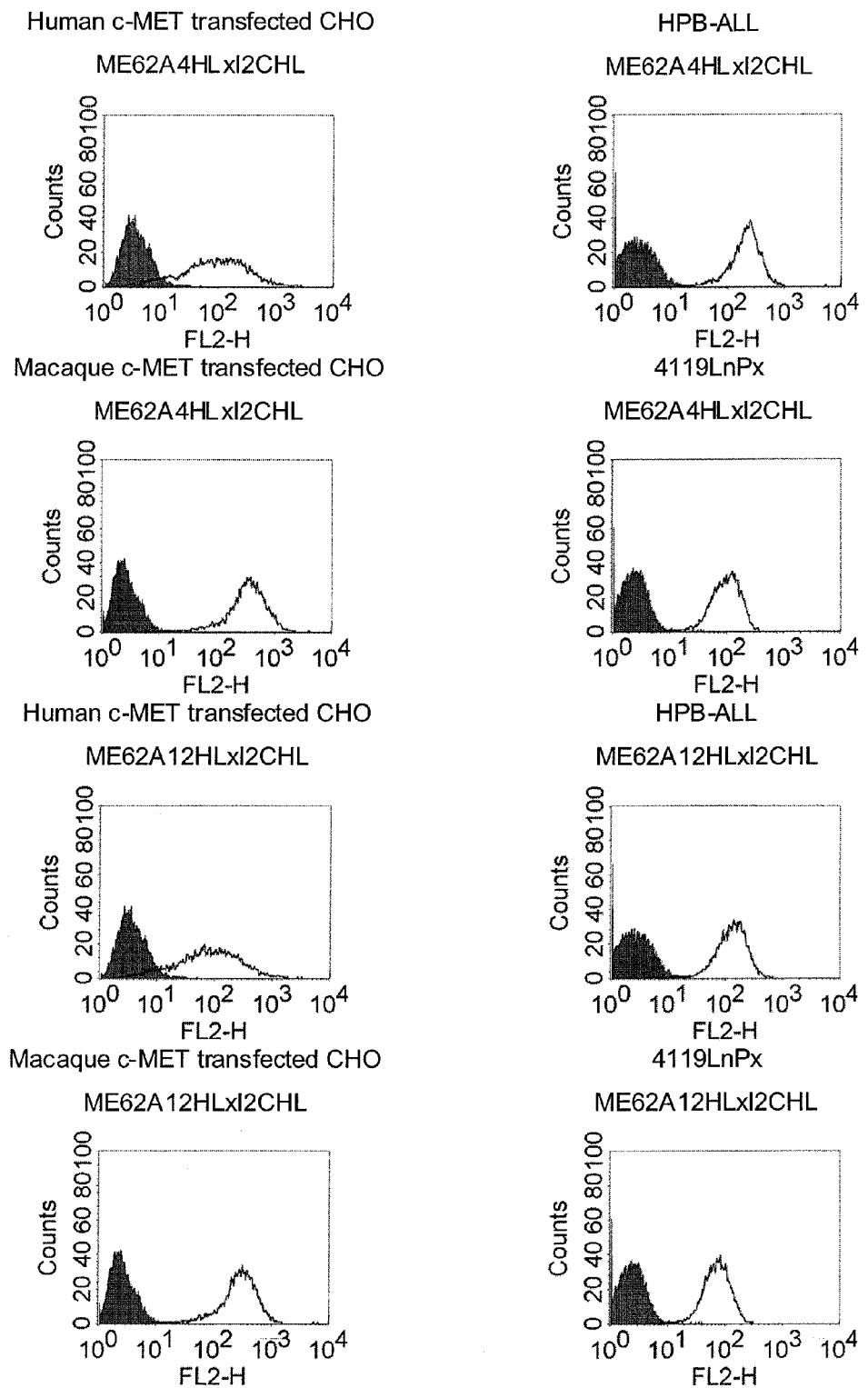
Figure 13B:
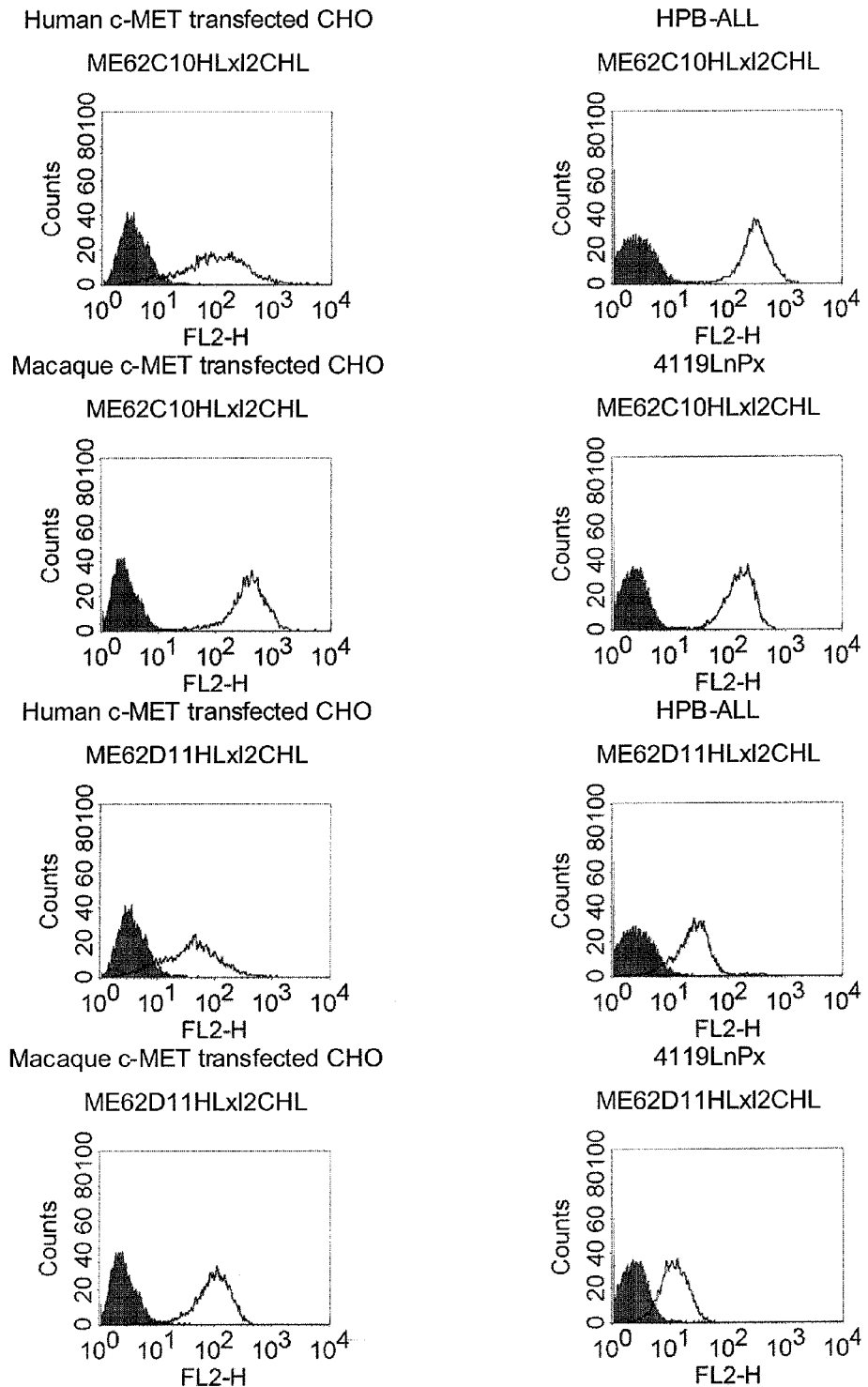
Figure 13C:
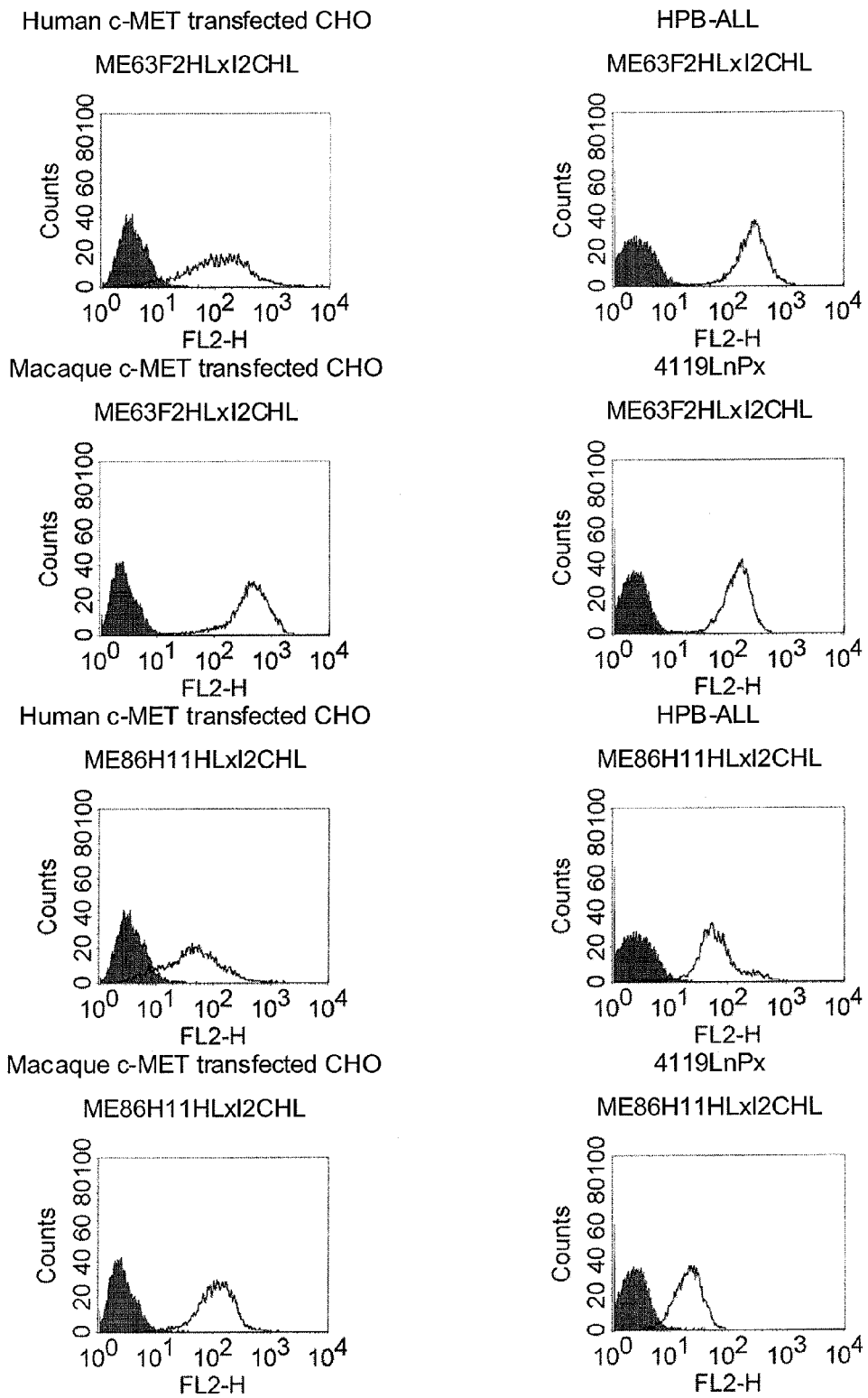
Figure 14A:
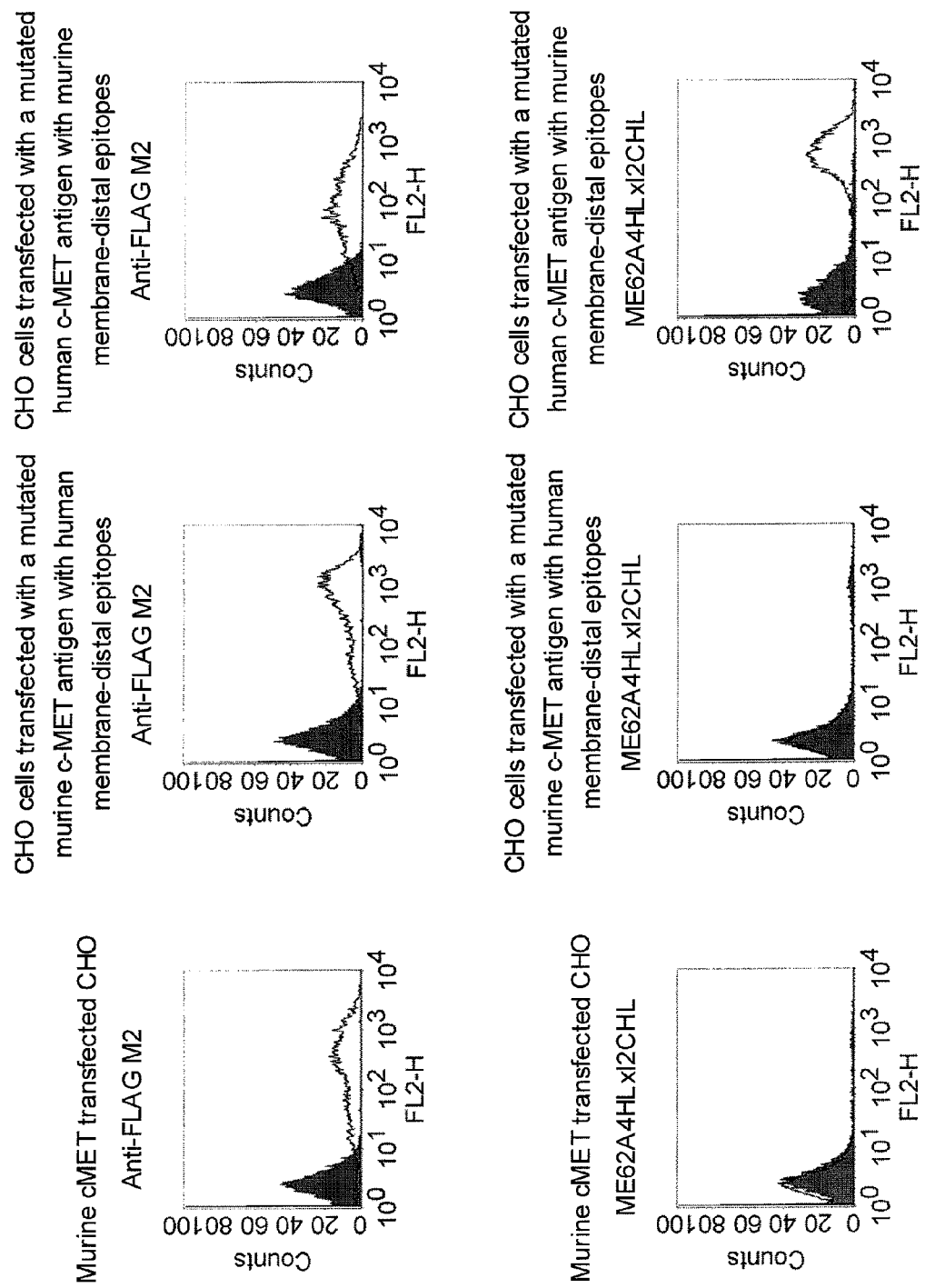
Figure 14B:
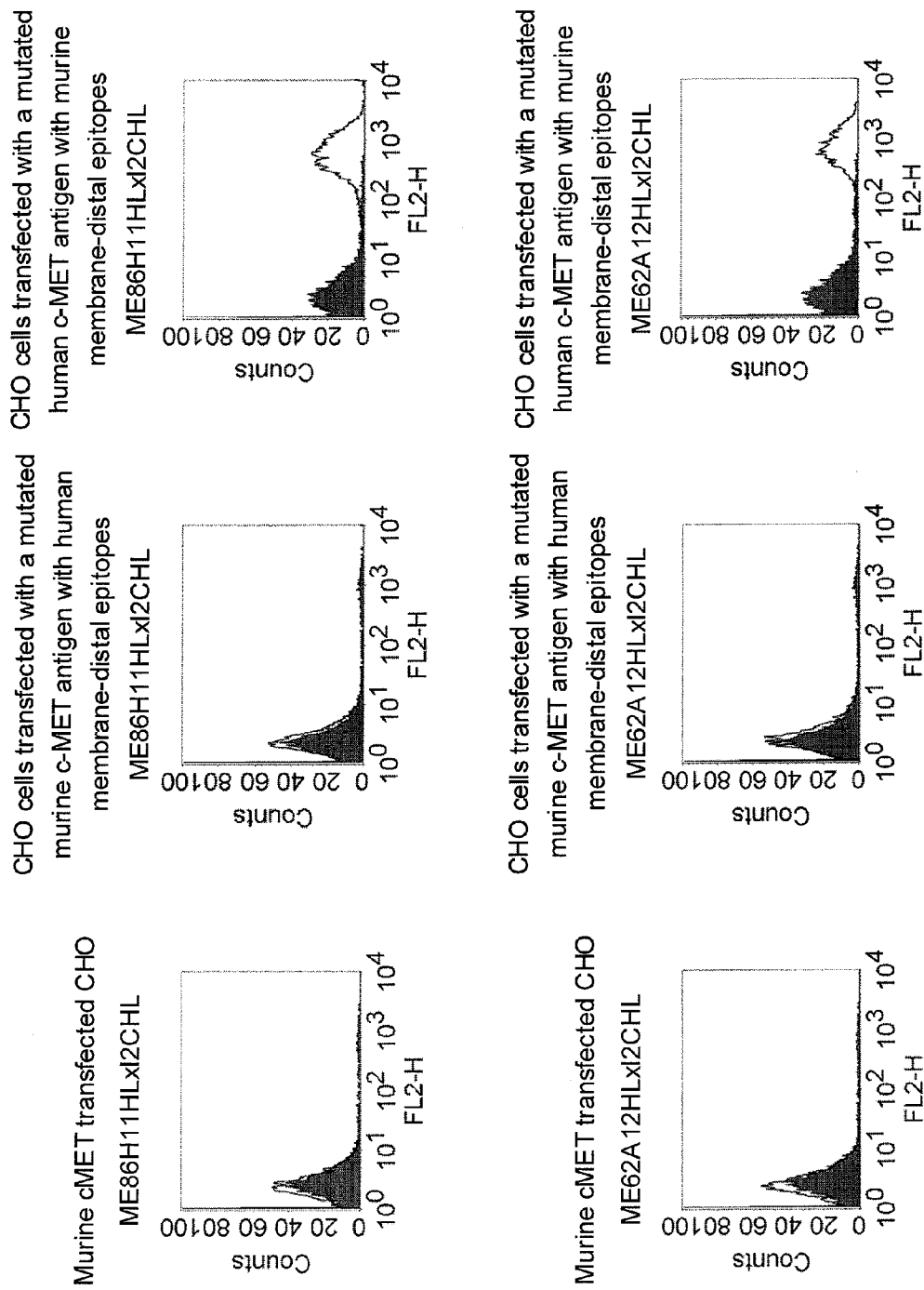
Figure 14C:
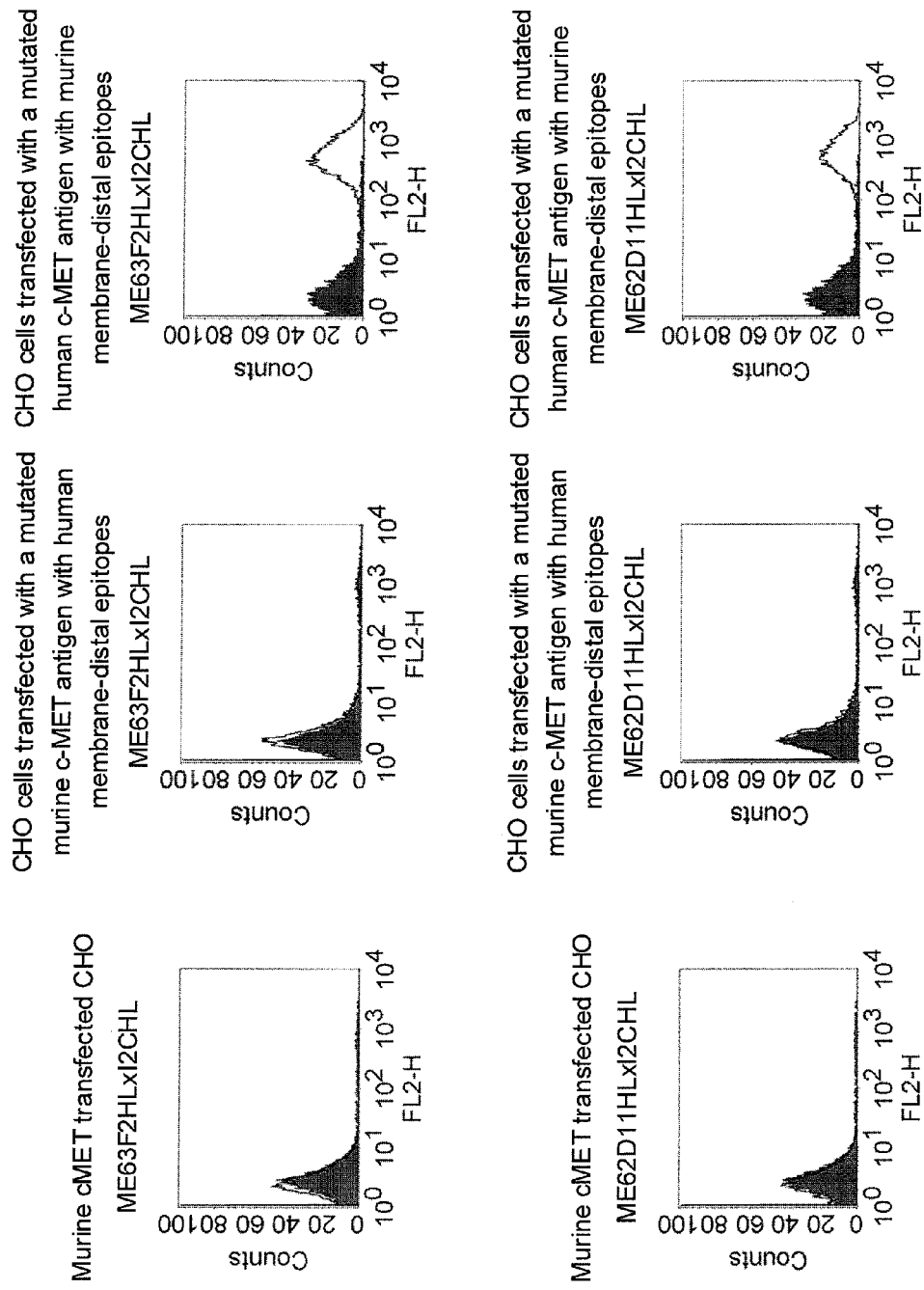
Figure 14D:
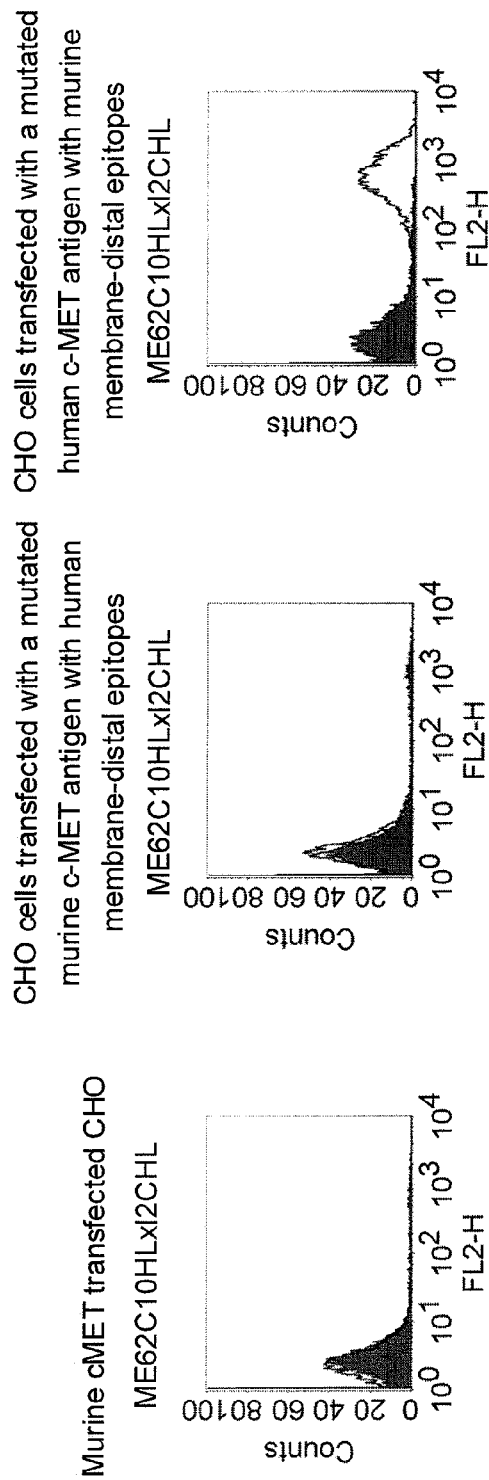
Figure 16A:
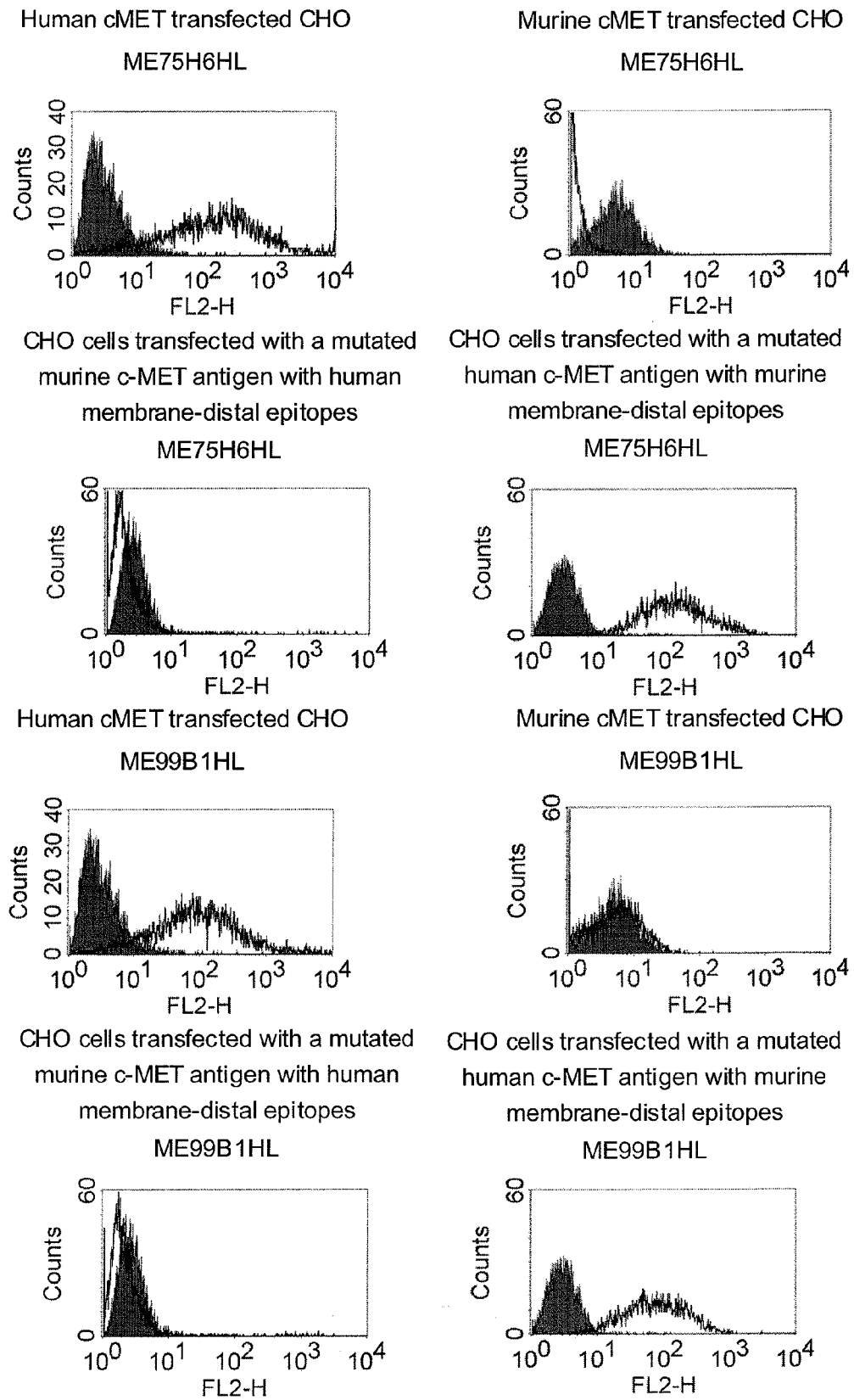
Figure 16B:
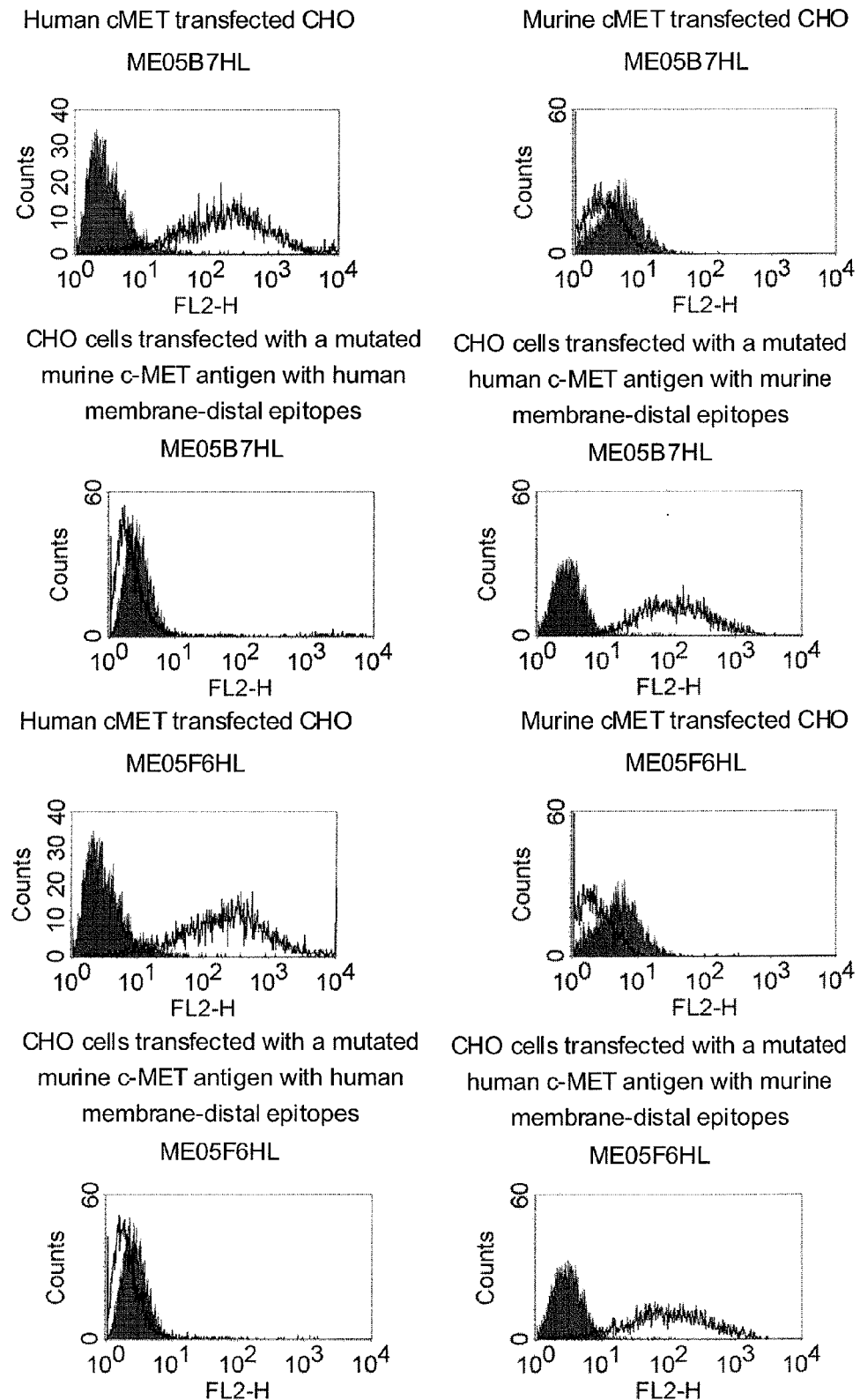
Figure 16C:
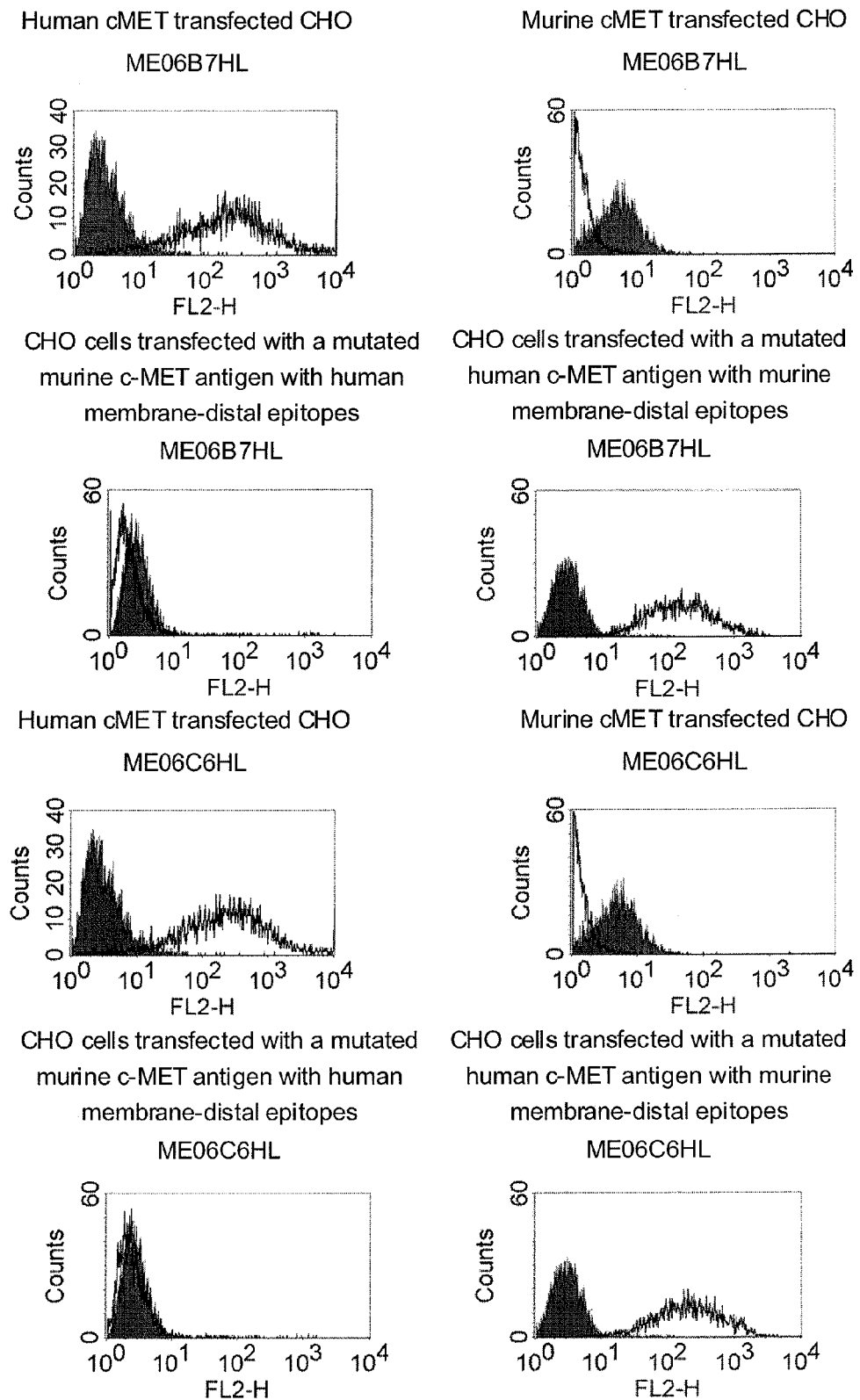
Figure 16D:
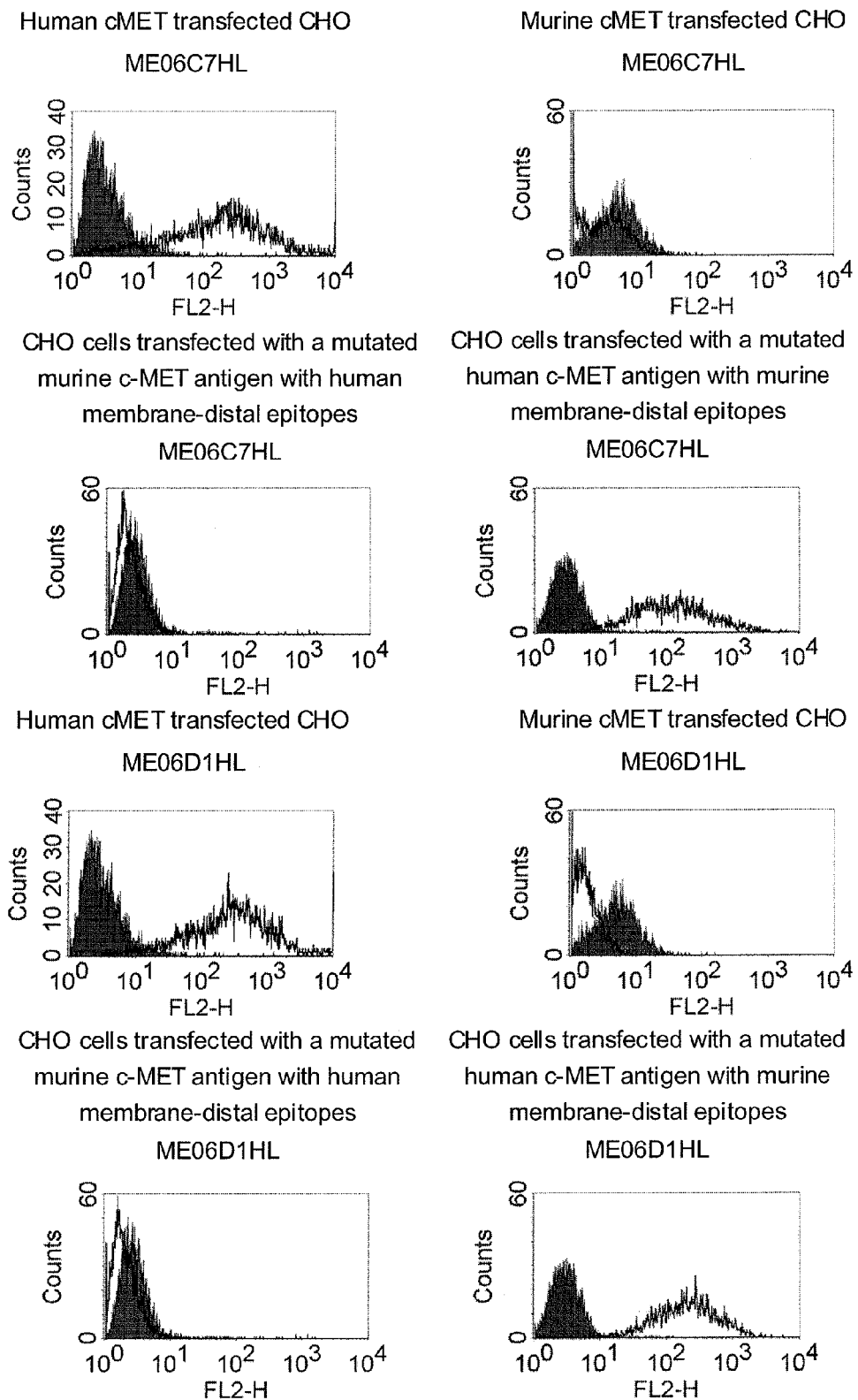
Figure 16E:
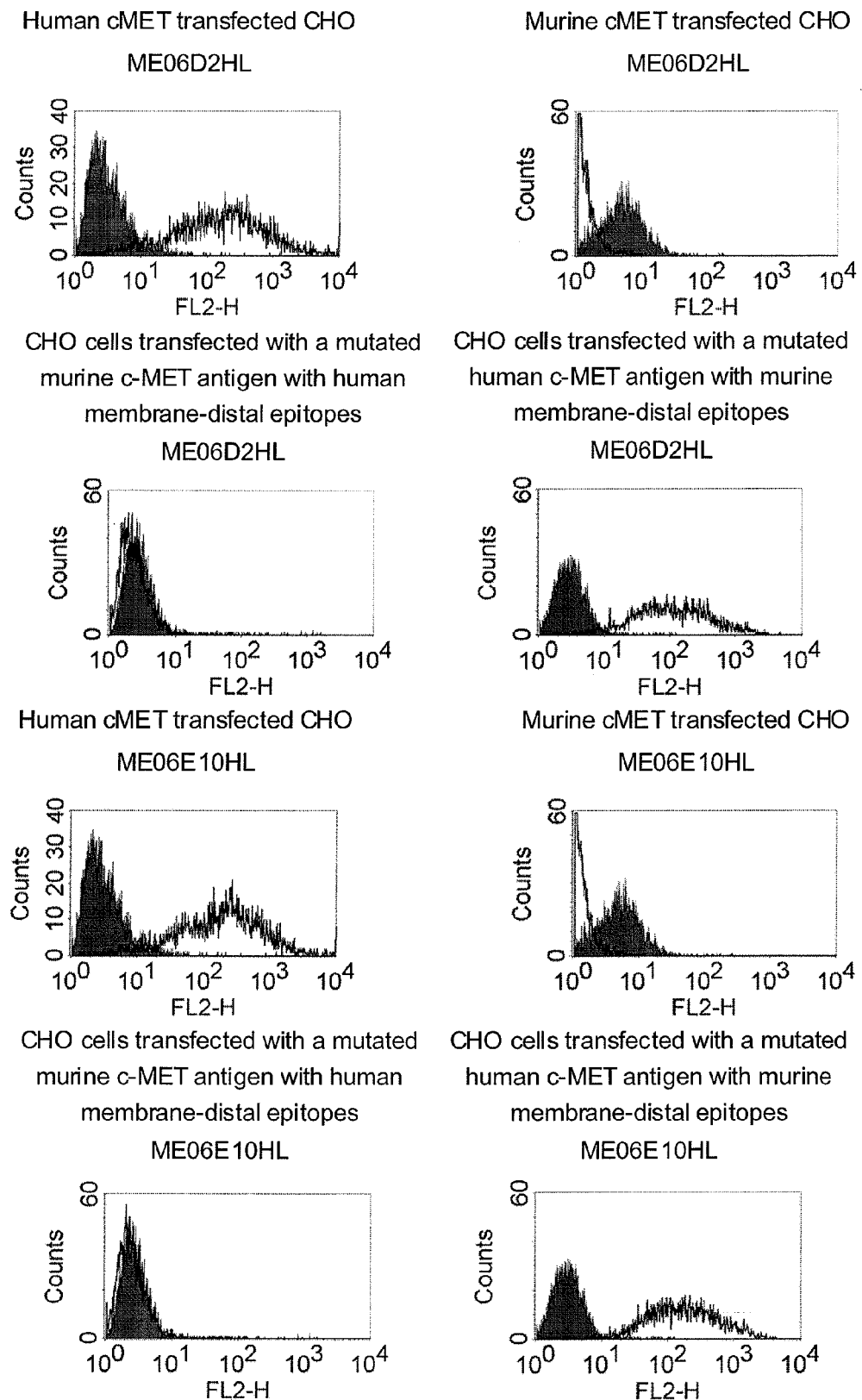
Figure 16F:
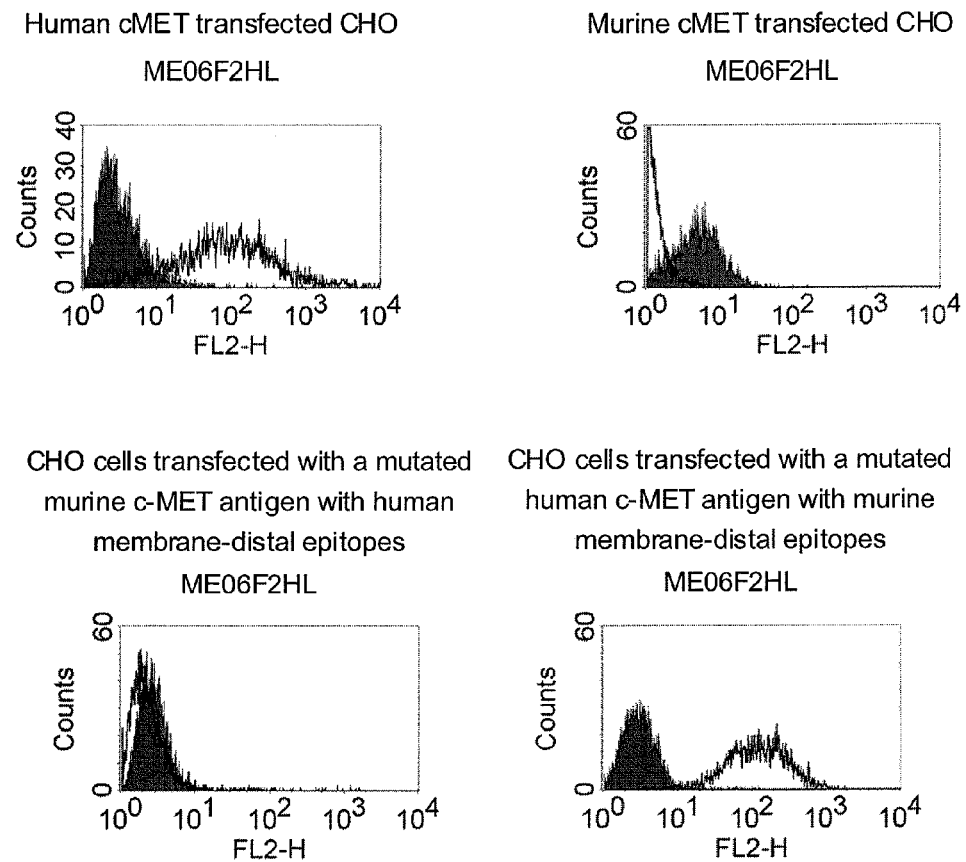

The bispecific binding of the single chain molecules listed above was clearly detectable as shown in FIG. 13. In the FACS analysis all constructs showed binding to human CD3 and human c-MET compared to the negative control. Membrane-proximal target binding of the single chain molecules listed above was clearly detectable as shown in FIG. 14. In the FACS analysis all constructs showed binding to the mutated human c-MET antigen with murine membrane-distal epitopes and did not show binding to the murine c-MET antigen and did also not show binding to the mutated murine c-MET antigen with human membrane-distal epitopes as compared to the negative control. Expression of the c-MET antigens was confirmed by detection with an anti-FLAG M2 antibody as described herein. In the FACS analysis also shown in FIG. 14 CHO cells transfected with the murine c-MET antigen, the mutated murine c-MET antigen with human membrane-distal epitopes and the mutated human c-MET antigen with murine membrane-distal epitopes, respectively, showed comparable expression of the antigens as detected with the anti-FLAG antibody.

7.14 Bioactivity of Bispecific Antibodies Directed at Membrane-proximal Target Epitopes of Human c-MET Bioactivity of generated bispecific single chain antibodies is analyzed by chromium 51 ($^{51}Cr$) release in vitro cytotoxicity assays using the CHO cells transfected with human c-MET described in Example 7.17. To confirm that significant bioactivity is only recruited by binding to membrane-proximal target epitopes of human c-MET—in addition— CHO cells expressing murine c-MET and the mutated murine c-MET antigen with human membrane-distal epitopes, respectively, both as described in Example 7.17 are used. As effector cells stimulated human CD4/CD56 depleted PBMC are used.

Stimulated human PBMC are obtained as follows:

A Petri dish (145 mm diameter, Greiner bio-one GmbH, Kremsmünster) is coated with a commercially available anti-CD3 specific antibody (e.g. OKT3, Orthoclone) in a final concentration of 1 µg/ml for 1 hour at 37° C. Unbound protein is removed by one washing step with PBS. The fresh PBMC are isolated from peripheral blood (30-50 ml human blood) by Ficoll gradient centrifugation according to standard protocols. 3-5×$10^7$ PBMC are added to the precoated petri dish in 120 ml of RPMI 1640 with stabilized glutamine/10% FCS/ IL-2 20 U/ml (Proleukin, Chiron) and stimulated for 2 days. On the third day the cells are collected and washed once with RPMI 1640. IL 2 is added to a final concentration of 20 U/ml and the cells are cultivated again for one day in the same cell culture medium as above.

By depletion of CD4+ T cells and CD56+ NK cells according to standard protocols CD8+ cytotoxic T lymphocytes (CTLs) are enriched.

Target cells are washed twice with PBS and labeled with 11.1 MBq $^{51}$Cr in a final volume of 100 µl RPMI with 50% FCS for 60 minutes at 37° C. Subsequently the labeled target cells are washed 3 times with 5 ml RPMI and then used in the cytotoxicity assay. The assay is performed in a 96 well plate in a total volume of 250 µl supplemented RPMI (as above) with an E:T ratio of 10:1. Supernatant of cells expressing the bispecific single chain antibody molecules in a final concentration of 50% and 20 threefold dilutions thereof are applied. The assay time is 18 hours. Cytotoxicity is measured as relative values of released chromium in the supernatant related to the difference of maximum lysis (addition of Triton-X) and spontaneous lysis (without effector cells). All measurements are done in quadruplicates. Measurement of chromium activity in the supernatants is performed with a Wizard® 3" gammacounter (Perkin Elmer Life Sciences GmbH, Koln, Germany). Analysis of the experimental data is performed with Prism 4 for Windows® (version 4.02, GraphPad Software Inc., San Diego, Calif., USA). Sigmoidal dose response curves typically have $R^2$ values >0.90 as determined by the software.

Only those constructs showing potent recruitment of cytotoxic activity of effector T cells against target cells positive for c-MET are selected for further use.

As shown in FIG. 15 all of the generated bispecific antibodies directed at membrane-proximal target epitopes of human c-MET demonstrated cytotoxic activity against human c-MET positive target cells elicited by stimulated human CD4/CD56 depleted PBMC but did not recruit significant cytotoxic activity against murine c-MET positive target cells and target cells positive for the mutated murine c-MET antigen with human membrane-distal epitopes. Thereby specific recruitment of cytotoxic activity via binding to membrane-proximal target epitopes of human c-MET was confirmed.

7.15 Generation of CHO Cells Expressing Macaque c-MET

The cDNA sequence of macaque c-MET is obtained by a set of 5 PCRs on cDNA from macaque monkey Liver prepared according to standard protocols. The following reaction conditions: 1 cycle at 94° C. for 2 minutes followed by 40 cycles with 94° C. for 1 minute, 56° C. for 1 minute and 72° C. for 3 minutes followed by a terminal cycle of 72° C. for 3 minutes and the following primers are used:

```
1. forward primer:
   5'-aggaattcaccatgaaggcccc
   gctgtgcttgcacc-3'          SEQ ID NO: 396
   reverse primer:
   5'-ctccagaggcatttccatgtagg-3'  SEQ ID NO: 397

2. forward primer:
   5'-gtccaaagggaaactctagatgc-3'  SEQ ID NO: 398
   reverse primer:
   5'-ggagacactggatgggagtccagg-3' SEQ ID NO: 399

3. forward primer:
   5'-catcagagggtcgcttcatgcagg-3' SEQ ID NO: 400
   reverse primer:
   5'-gctttggttttcaggggagttgc-3'  SEQ ID NO: 401

4. forward primer:
   5'-atccaaccaaatcttttattagt       SEQ ID NO: 402
```
```
   ggtgg-3'
   reverse primer:
   5'-gacttcattgaaatgcacaatcagg-3' SEQ ID NO: 403

5. forward primer:
   5'-tgctctaaatccagagctggtcc-3'   SEQ ID NO: 404
   reverse primer:
   5'-gtcagataagaaattccttagaatcc-3' SEQ ID NO: 405
```

These PCRs generate five overlapping fragments, which are isolated and sequenced according to standard protocols using the PCR primers, and thereby provide a portion of the cDNA sequence coding macaque c-MET from codon 10 of the leader peptide to the last codon of the mature protein. To generate a construct for expression of macaque c-MET a cDNA fragment is obtained by gene synthesis according to standard protocols (the cDNA and amino acid sequence of the construct is listed under SEQ ID Nos 406 and 407). In this construct the coding sequence of macaque c-MET from amino acid 10 of the leader peptide to the last amino acid of the mature c-MET protein followed by a stop codon is fused in frame to the coding sequence of the amino acids 1 to 9 of the leader peptide of the human c-MET protein. The gene synthesis fragment is also designed as to contain a Kozak site for eukaryotic expression of the construct and restriction sites at the beginning and the end of the fragment containing the cDNA. The introduced restriction sites, EcoRI at the 5' end and SalI at the 3' end, are utilised in the following cloning procedures. Internal restriction sites are removed by silent mutation of the coding sequence in the gene synthesis fragment. The gene synthesis fragment is cloned via EcoRI and SalI into a plasmid designated pEF-DHFR (pEF-DHFR is described in Raum et al. Cancer Immunol Immunother 50 (2001) 141-150) following standard protocols. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

7.16 Flow Cytometric Analysis of Cross-species Specificity of Bispecific Antibodies Directed at Membrane-proximal Target Epitopes of Human c-MET In order to test the cross-species specificity of bispecific antibodies directed at membrane-proximal target epitopes of human c-MET the capability of the constructs to bind to macaque c-MET and macaque CD3, respectively, is investigated by FACS analysis. For this purpose the macaque c-MET transfected CHO cells as described in example 7.17 and the macaque T cell line 4119LnPx (kindly provided by Prof Fickenscher, Hygiene Institute, Virology, Erlangen-Nuernberg; published in Knappe A, et al., and Fickenscher H., Blood 2000, 95, 3256-61) are used. 200,000 cells of the respective cell lines are incubated for 30 min on ice with 50 µl of cell culture supernatant of transfected cells expressing the cross-species specific bispecific antibody constructs. The cells are washed twice in PBS with 2% FCS and binding of the construct is detected with a murine Penta His antibody (Qiagen; diluted 1:20 in 50 µl PBS with 2% FCS). After washing, bound anti His antibodies are detected with an Fc gamma-specific antibody (Dianova) conjugated to phycoerythrin, diluted 1:100 in PBS with 2% FCS. Supernatant of untransfected cells is used as a negative control. Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

The cross-species specific binding of the single chain molecules listed above was clearly detectable as shown in FIG. 13. In the FACS analysis all constructs showed binding to macaque CD3 and macaque c-MET compared to the negative control.

7.17 Generation of CHO Cells with Enhanced Expression of Extracellular Domains of Human c-MET, Macaque c-MET, Murine c-MET, Mutated Murine c-MET with Human Membrane-distal Epitopes and Mutated Human c-MET with Murine Membrane-distal Epitopes, Respectively The modified coding sequences of human c-MET, macaque c-MET, murine c-MET, mutated murine c-MET with human membrane-distal epitopes and mutated human c-MET with murine membrane-distal epitopes as described above are used for the construction of artificial cDNA sequences encoding fusion proteins of the extracellular domains of human c-MET, macaque c-MET, murine c-MET, mutated murine c-MET with human membrane-distal epitopes and mutated human c-MET with murine membrane-distal epitopes, respectively, with a truncated variant of human EpCAM. To generate constructs for expression of these c-MET fusion proteins cDNA fragments are obtained by gene synthesis according to standard protocols (the cDNA and amino acid sequences of the constructs are listed under SEQ ID Nos 489 and 490 for human c-MET, 491 and 492 for macaque c-MET, 493 and 494 for murine c-MET, 495 and 496 for mutated murine c-MET with human membrane-distal epitopes and 497 and 498 for mutated human c-MET with murine membrane-distal epitopes). The gene synthesis fragments are designed as to contain first a Kozak site for eukaryotic expression of the construct, followed by the coding sequence of a 19 amino acid immunoglobulin leader peptide, followed in frame by the coding sequence of a FLAG tag (only in the case of the murine and the mutated human and mutated murine constructs), followed in frame by the coding sequence of the extracellular domains of human c-MET, macaque c-MET, murine c-MET, mutated murine c-MET with human membrane-distal epitopes and mutated human c-MET with murine membrane-distal epitopes, respectively, followed in frame by the coding sequence of an artificial $Ser_1$-$Gly_4$-$Ser_1$-$Gly_1$-linker, followed in frame by the coding sequence of the transmembrane domain and intracellular domain of human EpCAM (as published in GenBank; Accession number NM_002354; amino acids 266 to 314 [as counted from the start codon] except for a point mutation at position 279 with isoleucine instead of valine) and a stop codon. The gene synthesis fragments are also designed as to introduce restriction sites at the beginning and at the end of the fragment. The introduced restriction sites, EcoRI at the 5' end and SalI at the 3' end, are utilized in the following cloning procedures. The gene synthesis fragments are cloned via EcoRI and SalI into a plasmid designated pEF-DHFR (pEF-DHFR is described in Raum et al. Cancer Immunol Immunother 50 (2001) 141-150) following standard protocols. Clones with sequence-verified nucleotide sequence are transfected into DHFR deficient CHO cells for eukaryotic expression of the constructs. Eukaryotic protein expression in DHFR deficient CHO cells is performed as described by Kaufmann R. J. (1990) Methods Enzymol. 185, 537-566. Gene amplification of the constructs is induced by increasing concentrations of methotrexate (MTX) to a final concentration of up to 20 nM MTX.

8. Generation of Bispecific Single Chain Antibodies Directed at Membrane-proximal Target Epitopes of Human Endosialin 8.1 Generation of CHO Cells Expressing Human Endosialin The coding sequence of human Endosialin as published in GenBank (Accession number NM_020404) is obtained by gene synthesis according to standard protocols. The gene synthesis fragment is designed as to contain first a Kozak site for eukaryotic expression of the construct followed by the coding sequence of the human Endosialin protein, followed in frame by the coding sequence of a Flag tag and a stop codon (the cDNA and amino acid sequence of the construct is listed under SEQ ID Nos 408 and 409). The gene synthesis fragment is also designed as to introduce restriction sites at the beginning and at the end of the fragment. The introduced restriction sites, EcoRI at the 5' end and XbaI at the 3' end, are utilized in the following cloning procedures. The gene synthesis fragment is cloned via EcoRI and XbaI into a plasmid designated pEF-DHFR (pEF-DHFR is described in Raum et al. Cancer Immunol Immunother 50 (2001) 141-150) following standard protocols. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

8.2 Generation of a Soluble Human Endosialin Fusion Protein

The coding sequence of human Endosialin as described in Example 8.1 is used for the construction of an artificial cDNA sequence encoding a soluble fusion protein of human Endosialin and murine IgG1 Fc. To generate a construct for expression of the soluble human Endosialin fusion protein a cDNA fragment is obtained by gene synthesis according to standard protocols (the cDNA and amino acid sequence of the construct is listed under SEQ ID Nos 410 and 411). The gene synthesis fragment is designed as to contain first a Kozak site for eukaryotic expression of the construct followed by the coding sequence of the human Endosialin protein from amino acid 1 to 685 corresponding to the signal peptide and extracellular domains of human Endosialin, followed in frame by the coding sequence of an artificial $Thr_1$-$Gly_4$-$Ser_1$-linker, followed in frame by the coding sequence of the hinge region and Fc gamma portion of murine IgG1, followed in frame by the coding sequence of a 6 histidine tag and a stop codon. The gene synthesis fragment is also designed as to introduce restriction sites at the beginning and at the end of the fragment. The introduced restriction sites, EcoRI at the 5' end and XbaI at the 3' end, are utilized in the following cloning procedures. The gene synthesis fragment is cloned via EcoRI and XbaI into a plasmid designated pEF-DHFR (pEF-DHFR is described in Raum et al. Cancer Immunol Immunother 50 (2001) 141-150) following standard protocols. The aforementioned procedures are all carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX. After two passages of stationary culture the cells are grown in roller bottles with nucleoside-free HyQ PF CHO liquid soy medium (with 4.0 mM L-Glutamine with 0.1% Pluronic F-68; HyClone) for 7 days before harvest. The cells are removed by centrifugation and the supernatant containing the expressed protein is stored at −20° C. Alternatively a clone of the expression plasmid with sequence-verified nucleotide sequence is used for transfection and protein expression in the FreeStyle 293 Expression System (Invitrogen GmbH, Karlsruhe, Germany) according to the manufacturer's protocol. Supernatant containing the expressed protein is obtained, cells are removed by centrifugation and the supernatant is stored at −20° C.

For purification of the soluble human Endosialin fusion protein a goat anti-mouse Fc affinity column is prepared according to standard protocols using a commercially available affinity purified goat anti-mouse IgG Fc fragment specific antibody with minimal cross-reaction to human, bovine and horse serum proteins (Jackson ImmunoResearch Europe Ltd.). Using this affinity column the fusion protein is isolated out of cell culture supernatant on an Äkta Explorer System (GE Amersham) and eluted by citric acid. The eluate is neutralized and concentrated.

8.3 Generation of CHO Cells Expressing the Murine Endosialin Antigen

The sequence of murine Endosialin (NM_054042 *Mus musculus* Endosialin antigen, endosialin (Cd248), mRNA; National Center for Biotechnology Information, http://www.ncbi.nlm.nih.gov/entrez) is used to obtain a synthetic cDNA molecule by gene synthesis according to standard protocols. The gene synthesis fragment is designed as to contain the coding sequence of an immunoglobulin heavy chain leader comprising a start codon embedded within a Kozak consensus sequence, followed in frame by the coding sequence of a FLAG tag, followed in frame by the complete coding sequence of mature murine endosialin (the cDNA and amino acid sequence of the construct is listed under SEQ ID Nos 412 and 413). The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150). The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

8.4 Generation of CHO Cells Expressing a Mutated Human Endosialin Antigen with Murine Membrane-distal Epitopes The coding sequence of a mutated human Endosialin antigen with murine membrane-distal epitopes is obtained by gene synthesis according to standard protocols. The gene synthesis fragment is designed as to contain the coding sequence of an immunoglobulin heavy chain leader comprising a start codon embedded within a Kozak consensus sequence, followed in frame by the coding sequence of a FLAG tag, followed in frame by the coding sequence of the C-type lectin domain of mature murine endosialin followed in frame by human endosialin from the Sushi/SCR/CCP domain to the stop codon (the cDNA and amino acid sequence of the construct is listed under SEQ ID Nos 414 and 415). The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150). The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

8.5 Generation of CHO Cells Expressing a Mutated Murine Endosialin Antigen with Human Membrane-distal Epitopes The coding sequence of a mutated murine Endosialin antigen with human membrane-distal epitopes is obtained by gene synthesis according to standard protocols. The gene synthesis fragment is designed as to contain the coding sequence of an immunoglobulin heavy chain leader comprising a start codon embedded within a Kozak consensus sequence, followed in frame by the coding sequence of a FLAG tag, followed in frame by the coding sequence of the C-type lectin domain of mature human endosialin followed in frame by murine endosialin from the Sushi/SCR/CCP domain to the stop codon (the cDNA and amino acid sequence of the construct is listed under SEQ ID Nos 416 and 417). The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150). Internal restriction sites are removed by silent mutation of the coding sequence in the gene synthesis fragment. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

8.6 Immunization of Mice Using a Soluble Human Endosialin Fusion Protein

Twelve weeks old F1 mice from BALB/c x C57BL/6 crossings are immunized with the soluble human Endosialin fusion protein as described in Example 8.2. To this end for each animal 40 µg of the soluble human Endosialin fusion protein are mixed with 10 nmol of a thioate-modified CpG-Oligonucleotide (5'-tccatgacgttcctgatgct-3') in 300 µl PBS and are injected intraperitoneally. Mice receive booster immunizations after 21, 42 and optionally 63 days in the same way. Ten days after the first booster immunization, blood samples are taken and antibody serum titers against human Endosialin are tested by flow cytometry according to standard protocols. To this end 200,000 cells of the human Endosialin transfected CHO cells as described in Example 8.1 are incubated for 30 min on ice with 50 µl of serum of the immunized animals diluted 1:1000 in PBS with 2% FCS. The cells are washed twice in PBS with 2% FCS and binding of serum antibodies is detected with an mouse Fc gamma-specific antibody (Dianova) conjugated to phycoerythrin, diluted 1:100 in PBS with 2% FCS. Serum of the animals obtained prior to immunization is used as a negative control.

Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

Animals demonstrating significant serum reactivity against human Endosialin as determined by the FACS analysis are used in the subsequent experiment.

8.7 Generation of an Immune Murine Antibody scFv Library: Construction of a Combinatorial Antibody Library and Phage Display Three days after the last booster immunization spleen cells of reactive animals are harvested for the preparation of total RNA according to standard protocols.

A library of murine immunoglobulin (Ig) light chain (kappa) variable region (VK) and Ig heavy chain variable region (VH) DNA-fragments is constructed by RT-PCR on murine spleen RNA using VK- and VH specific primers. cDNA is synthesized according to standard protocols, see example 2.7.

450 ng of the kappa light chain fragments (SacI-SpeI digested) are ligated with 1400 ng of the phagemid pComb3H5Bhis (SacI-SpeI digested; large fragment). The resulting combinatorial antibody library is then transformed into 300 µl of electrocompetent *Escherichia coli* XL1 Blue cells by electroporation (2.5 kV, 0.2 cm gap cuvette, 25 µFD, 200 Ohm, Biorad gene-pulser) resulting in a library size of more than $10^7$ independent clones. After one hour of phenotype expression, positive transformants are selected for carbenicillin resistance encoded by the pComb3H5BHis vector in 100 ml of liquid super broth (SB)-culture over night. Cells are then harvested by centrifugation and plasmid preparation is carried out using a commercially available plasmid preparation kit (Qiagen).

2800 ng of this plasmid-DNA containing the VK-library (XhoI-BstEII digested; large fragment) are ligated with 900 ng of the heavy chain V-fragments (XhoI-BstEII digested) and again transformed into two 300 µl aliquots of electrocompetent *E. coli* XL1 Blue cells by electroporation (2.5 kV, 0.2 cm gap cuvette, 25 µFD, 200 Ohm) resulting in a total VH-VK scFv (single chain variable fragment) library size of more than $10^7$ independent clones.

After phenotype expression and slow adaptation to carbenicillin, the *E. coli* cells containing the antibody library are transferred into SB-Carbenicillin (SB with 50 µg/mL carbenicillin) selection medium. The *E. coli* cells containing the antibody library are then infected with an infectious dose of $10^{12}$ particles of helper phage VCSM13 resulting in the production and secretion of filamentous M13 phage, wherein each phage particle contains single stranded pComb3H5BHis-DNA encoding a murine scFv-fragment and displays the corresponding scFv-protein as a translational fusion to phage coat protein III. This pool of phages displaying the antibody library is later used for the selection of antigen binding entities.

8.8 Phage Display Based Selection of Membrane-proximal Target Binders on CHO Cells Expressing the Mutated Human Endosialin Antigen with Murine Membrane-distal Epitopes The phage library carrying the cloned scFv-repertoire is harvested from the respective culture supernatant by PEG8000/NaCl precipitation and centrifugation. Approximately $10^{11}$ to $10^{12}$ scFv phage particles are resuspended in 0.4 ml of PBS/0.1% BSA and incubated with $10^5$ to $10^7$ CHO cells expressing the mutated human Endosialin antigen with murine membrane-distal epitopes as described in example 8.4 for 1 hour on ice under slow agitation. These CHO cells are grown beforehand, harvested by centrifugation, washed in PBS and resuspended in PBS/1% FCS (containing Na Azide). scFv phage which do not specifically bind to the CHO cells are eliminated by up to five washing steps with PBS/1% FCS (containing Na Azide). After washing, binding entities are eluted from the cells by resuspending the cells in HCl-glycine pH 2.2 (10 min incubation with subsequent vortexing) and after neutralization with 2 M Tris pH 12, the eluate is used for infection of a fresh uninfected *E. coli* XL1 Blue culture (OD600>0.5). The *E. coli* culture containing *E. coli* cells successfully transduced with a phagemid copy, encoding a murine scFv-fragment, are again selected for carbenicillin resistance and subsequently infected with VCMS 13 helper phage to start the second round of antibody display and in vitro selection. Typically a total of 4 to 5 rounds of selections are carried out.

8.9 Screening for Membrane-proximal Target Binders on CHO Cells Expressing the Human Endosialin Antigen, the Murine Endosialin Antigen and the Mutated Murine Endosialin Antigen with Human Membrane-distal Epitopes Plasmid DNA corresponding to 4 and 5 rounds of panning is isolated from *E. coli* cultures after selection. For the production of soluble scFv-protein, VH-VL-DNA fragments are excised from the plasmids (XhoI-SpeI). These fragments are cloned via the same restriction sites in the plasmid pComb3H5BFlag/His differing from the original pComb3H5BHis in that the expression construct (e.g. scFv) includes a Flag-tag (TGDYKDDDDK) between the scFv and the His6-tag and the additional phage proteins are deleted. After ligation, each pool (different rounds of panning) of plasmid DNA is transformed into 100 µl heat shock competent *E. coli* TG1 or XLI blue and plated onto carbenicillin LB-agar. Single colonies are picked into 100 µl of LB carb (LB with 50 µg/ml carbenicillin).

After induction with 1 mM IPTG *E. coli* transformed with pComb3H5BFlag/His containing a VL- and VH-segment produce soluble scFv in sufficient amounts. Due to a suitable signal sequence, the scFv is exported into the periplasma where it folds into a functional conformation.

Single *E. coli* bacterial colonies from the transformation plates are picked for periplasmic small scale preparations and grown in SB-medium (e.g. 10 ml) supplemented with 20 mM $MgCl_2$ and carbenicillin 50 µg/ml (and re-dissolved in PBS (e.g. 1 ml) after harvesting. A temperature shock is applied by four rounds of freezing at −70° C. and thawing at 37° C. whereby the outer membrane of the bacteria is destroyed and the soluble periplasmic proteins including the scFvs are released into the supernatant. After elimination of intact cells and cell-debris by centrifugation, the supernatant containing the murine anti-human Endosialin-scFvs is collected and used for further examination.

Screening of the isolated scFvs for membrane-proximal target binders is performed by flow cytometry on CHO cells expressing the human Endosialin antigen as described in Example 8.1, the murine Endosialin antigen as described in Example 8.3 and the mutated murine Endosialin antigen with human membrane-distal epitopes as described in Example 8.5.

For flow cytometry $2.5 \times 10^5$ cells of the respective cell lines are incubated with 50 µl supernatant. The binding of the constructs is detected with an anti-His antibody (Penta-His Antibody, BSA free, Qiagen GmbH, Hilden, FRG) at 2 µg/ml in 50 µl PBS with 2% FCS. As a second step reagent a R-Phycoerythrin-conjugated affinity purified F(ab')2 fragment, goat anti-mouse IgG (Fc-gamma fragment specific), diluted 1:100 in 50 µl PBS with 2% FCS (Dianova, Hamburg, FRG) is used. The samples are measured on a FACSscan (BD biosciences, Heidelberg, FRG).

Only constructs which show binding to CHO cells expressing the human Endosialin antigen and do not show binding to CHO cells expressing the murine Endosialin antigen and also do not show binding to CHO cells expressing the mutated murine Endosialin antigen with human membrane-distal epitopes are selected for further use.

8.10 Generation of Human/Humanized Equivalents of Non-human scFvs to Membrane-proximal Target Epitopes of Human Endosialin The VH region of a murine anti-Endosialin scFv to a membrane-proximal target epitope of human Endosialin is aligned against human antibody germline amino acid sequences. The human antibody germline VH sequence is chosen which has the closest homology to the non-human VH and a direct alignment of the two amino acid sequences is performed. There are a number of framework residues of the non-human VH that differ from the human VH framework regions ("different framework positions"). Some of these residues may contribute to the binding and activity of the antibody to its target.

To construct a library that contains the murine CDRs and at every framework position that differs from the chosen human VH sequence both possible residues (the human and the maternal murine amino acid residue), degenerated oligonucleotides are synthesized. These oligonucleotides incorporate at the differing positions the human residue with a probability of 75% and the murine residue with a probability of 25%. For one human VH e.g. six of these oligonucleotides have to be synthesized that overlap in a terminal stretch of approximately 20 nucleotides. To this end every second primer is an antisense primer. Restriction sites within the oligonucleotides needed for later cloning are deleted.

These primers may have a length of 60 to 90 nucleotides, depending on the number of primers that are needed to span over the whole V sequence.

These e.g. six primers are mixed in equal amounts (e.g. 1 µl of each primer (primer stocks 20 to 100 µM) to a 20 µl PCR reaction) and added to a PCR mix consisting of PCR buffer, nucleotides and Taq polymerase. This mix is incubated at 94° C. for 3 minutes, 65° C. for 1 minute, 62° C. for 1 minute, 59° C. for 1 minute, 56° C. for 1 minute, 52° C. for 1 minute, 50° C. for 1 minute and at 72° C. for 10 minutes in a PCR cycler. Subsequently the product is run in an agarose gel electrophoresis and the product of a size from 200 to 400 base pairs isolated from the gel according to standard methods.

This PCR product is then used as a template for a standard PCR reaction using primers that incorporate suitable N-terminal and C-terminal cloning restriction sites. The DNA fragment of the correct size (for a VH approximately 350 nucleotides) is isolated by agarose gel electrophoresis according to standard methods. In this way sufficient VH DNA fragment is amplified. This VH fragment is now a pool of VH fragments that have each one a different amount of human and murine residues at the respective differing framework positions (pool of humanized VH). The same procedure is performed for the VL region of the murine anti-Endosialin scFv to a membrane-proximal target epitope of human Endosialin (pool of humanized VL). The pool of humanized VH is then combined with the pool of humanized VL in the phage display vector pComb3H5Bhis to form a library of functional scFvs from which—after display on filamentous phage—anti-Endosialin binders to membrane-proximal target epitopes of human Endosialin are selected, screened, identified and confirmed as described above for the parental non-human (murine) anti-Endosialin scFv. Single clones are then analyzed for favorable properties and amino acid sequence. Those scFvs, which are closest in amino acid sequence homology to human germline V-segments, are preferred.

Human/humanized anti-Endosialin scFvs to membrane-proximal target epitopes of human Endosialin are converted into recombinant bispecific single chain antibodies and further characterized as follows.

8.11 Generation of I2C-based Bispecific Single Chain Antibodies Directed at Membrane-proximal Target Epitopes of Human Endosialin Anti-Endosialin scFvs to membrane-proximal target epitopes of human Endosialin with favorable properties and amino acid sequence are converted into recombinant bispecific single chain antibodies by joining them via a $Gly_4Ser_1$-linker with the CD3 specific scFv I2C (SEQ ID NO: 185) to result in constructs with the domain arrangement $VH_{Endosialin}$-$(Gly_4Ser_1)_3$-$VL_{Endosialin}$-$Ser_1Gly_4Ser_1$-$VH_{CD3}$-$(Gly_4Ser_1)_3$-$VL_{CD3}$. Alternatively further constructs with different domain arrangements can be generated according to standard protocolls. For expression in CHO cells the coding sequences of (i) an N-terminal immunoglobulin heavy chain leader comprising a start codon embedded within a Kozak consensus sequence and (ii) a C-terminal His6-tag followed by a stop codon are both attached in frame to the nucleotide sequence encoding the bispecific single chain antibodies prior to insertion of the resulting DNA-fragment as obtained by gene synthesis into the multiple cloning site of the expression vector pEF-DHFR (Raum et al. Cancer Immunol Immunother 50 (2001) 141-150). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

8.12 Expression and Purification of Bispecific Single Chain Antibody Molecules Directed at Membrane-proximal Target Epitopes of Human Endosialin Bispecific single chain antibody molecules are expressed in Chinese hamster ovary cells (CHO). Eukaryotic protein expression in DHFR deficient CHO cells is performed as described by Kaufmann R. J. (1990) Methods Enzymol. 185, 537-566. Gene amplification of the constructs is induced by addition of increasing concentrations of MTX up to final concentrations of 20 nM MTX. After two passages of stationary culture cell culture supernatant is collected and used in the subsequent experiments. To generate supernatant for purification after two passages of stationary culture the cells are grown in roller bottles with nucleoside-free HyQ PF CHO liquid soy medium (with 4.0 mM L-Glutamine with 0.1% Pluronic F-68; HyClone) for 7 days before harvest. The cells are removed by centrifugation and the supernatant containing the expressed protein is stored at −20° C. Alternatively, constructs are transiently expressed in HEK 293 cells. Transfection is performed with 293fectin reagent (Invitrogen, #12347-019) according to the manufacturer's protocol. Furthermore the constructs are alternatively expressed in transiently transfected DHFR deficient CHO cells using for example FuGENE® HD Transfection Reagent (Roche Diagnostics GmbH, Cat. No. 04709691001) according to the manufacturer's protocol.

Äkta® Explorer System (GE Health Systems) and Unicorn® Software are used for chromatography. Immobilized metal affinity chromatography ("IMAC") is performed using a Fractogel EMD Chelate® (Merck) which is loaded with $ZnCl_2$ according to the protocol provided by the manufacturer. The column is equilibrated with buffer A (20 mM sodium phosphate buffer pH 7.2, 0.1 M NaCl) and the cell culture supernatant (500 ml) is applied to the column (10 ml) at a flow rate of 3 ml/min. The column is washed with buffer A to remove unbound sample. Bound protein is eluted using a two step gradient of buffer B (20 mM sodium phosphate buffer pH 7.2, 0.1 M NaCl, 0.5 M Imidazole) according to the following procedure:

Step 1: 20% buffer B in 6 column volumes
Step 2: 100% buffer B in 6 column volumes Eluted protein fractions from step 2 are pooled for further purification. All chemicals are of research grade and purchased from Sigma (Deisenhofen) or Merck (Darmstadt).

Gel filtration chromatography is performed on a HiLoad 16/60 Superdex 200 prep grade column (GE/Amersham) equilibrated with Equi-buffer (25 mM Citrate, 200 mM Lysine, 5% Glycerol, pH 7.2). Eluted protein samples (flow rate 1 ml/min) are subjected to standard SDS-PAGE and Western Blot for detection. Prior to purification, the column is calibrated for molecular weight determination (molecular weight marker kit, Sigma MW GF-200). Protein concentrations are determined using OD280 nm.

Purified bispecific single chain antibody protein is analyzed in SDS PAGE under reducing conditions performed with pre-cast 4-12% Bis Tris gels (Invitrogen). Sample preparation and application are performed according to the protocol provided by the manufacturer. The molecular weight is determined with MultiMark protein standard (Invitrogen). The gel is stained with colloidal Coomassie (Invitrogen protocol). The purity of the isolated protein is typically >95% as determined by SDS-PAGE.

The bispecific single chain antibody has a molecular weight of about 52 kDa under native conditions as determined by gel filtration in PBS.

Western Blot is performed using an Optitran® BA-S83 membrane and the Invitrogen Blot Module according to the protocol provided by the manufacturer. The antibody used is directed against the His Tag (Penta His, Qiagen) and a Goat-anti-mouse Ig labeled with alkaline phosphatase (AP) (Sigma) is used as second step reagent, and BCIP/NBT (Sigma) as substrate. A band detected at 52 kD corresponds to purified bispecific single chain antibodies.

8.13 Flow Cytometric Binding Analysis of Bispecific Antibodies Directed at Membrane-proximal Target Epitopes of Human Endosialin In order to test the functionality of bispecific antibody constructs regarding the capability to bind to CD3 and to membrane-proximal target epitopes of human Endosialin, respectively, a FACS analysis is performed. For this purpose CHO cells transfected with human Endosialin as described in Example 8.1 and the human CD3 positive T cell leukemia cell line HPB-ALL (DSMZ, Braunschweig, ACC483) are used.

For confirmation of binding to membrane-proximal target epitopes of human Endosialin—in addition—CHO cells expressing the murine Endosialin antigen as described in Example 8.3 and CHO cells expressing the mutated murine Endosialin antigen with human membrane-distal epitopes as described in Example 8.5 are used. 200,000 cells of the respective cell lines are incubated for 30 min on ice with 50 μl of cell culture supernatant of transfected cells expressing the bispecific antibody constructs. The cells are washed twice in PBS with 2% FCS and binding of the construct is detected with a murine Penta His antibody (Qiagen; diluted 1:20 in 50 μl PBS with 2% FCS). After washing, bound anti H is antibodies are detected with an Fc gamma-specific antibody (Dianova) conjugated to phycoerythrin, diluted 1:100 in PBS with 2% FCS. Supernatant of untransfected cells is used as a negative control. Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

Only those constructs that show bispecific binding to human CD3 as well as to human Endosialin and neither bind to the murine Endosialin antigen nor to the mutated murine Endosialin antigen with human membrane-distal epitopes are selected for further use.

8.14 Bioactivity of Bispecific Antibodies Directed at Membrane-proximal Target Epitopes of Human Endosialin Bioactivity of generated bispecific single chain antibodies is analyzed by chromium 51 ($^{51}Cr$) release in vitro cytotoxicity assays using the CHO cells transfected with human Endosialin described in Example 8.1. As effector cells stimulated human CD4/CD56 depleted PBMC are used.

Stimulated human PBMC are obtained as follows:

A Petri dish (145 mm diameter, Greiner bio-one GmbH, Kremsmunster) is coated with a commercially available anti-CD3 specific antibody (e.g. OKT3, Orthoclone) in a final concentration of 1 μg/ml for 1 hour at 37° C. Unbound protein is removed by one washing step with PBS. The fresh PBMC are isolated from peripheral blood (30-50 ml human blood) by Ficoll gradient centrifugation according to standard protocols. $3-5 \times 10^7$ PBMC are added to the precoated petri dish in 120 ml of RPMI 1640 with stabilized glutamine/10% FCS/IL-2 20 U/ml (Proleukin, Chiron) and stimulated for 2 days. On the third day the cells are collected and washed once with RPMI 1640. IL 2 is added to a final concentration of 20 U/ml and the cells are cultivated again for one day in the same cell culture medium as above.

By depletion of CD4+ T cells and CD56+ NK cells according to standard protocols CD8+ cytotoxic T lymphocytes (CTLs) are enriched.

Target cells are washed twice with PBS and labeled with 11.1 MBq $^{51}Cr$ in a final volume of 100 μl RPMI with 50% FCS for 60 minutes at 37° C. Subsequently the labeled target cells are washed 3 times with 5 ml RPMI and then used in the cytotoxicity assay. The assay is performed in a 96 well plate in a total volume of 250 μl supplemented RPMI (as above) with an E:T ratio of 10:1. 1 μg/ml of purified bispecific single chain antibody molecule and 20 threefold dilutions thereof are applied. The assay time is 18 hours. Cytotoxicity is measured as relative values of released chromium in the supernatant related to the difference of maximum lysis (addition of Triton-X) and spontaneous lysis (without effector cells). All measurements are done in quadruplicates. Measurement of chromium activity in the supernatants is performed with a Wizard® 3" gammacounter (Perkin Elmer Life Sciences GmbH, Koln, Germany). Analysis of the experimental data is performed with Prism 4 for Windows® (version 4.02, Graph-Pad Software Inc., San Diego, Calif., USA). Sigmoidal dose response curves typically have $R^2$ values >0.90 as determined by the software. EC50 values calculated by the analysis program are used for comparison of bioactivity.

Only those constructs showing potent recruitment of cytotoxic activity of effector T cells against target cells positive for Endosialin are selected for further use.

8.15 Generation of CHO Cells Expressing Macaque Endosialin

The cDNA sequence of macaque Endosialin is obtained by a set of 2 PCRs on cDNA from macaque monkey colon prepared according to standard protocols. The following reaction conditions: 1 cycle at 95° C. for 5 minutes followed by 40 cycles with 95° C. for 45 seconds, 50° C. for 45 seconds and 72° C. for 2 minutes followed by a terminal cycle of 72° C. for 5 minutes and the following primers are used for the first PCR:

```
forward primer:
5'-atatgaattcgccaccatgctgctgcgcct   SEQ ID NO: 418
gttgctggcc-3' reverse primer:
5'-gtcttcatcttcctcatcctcccc-3'      SEQ ID NO: 419
```

The following reaction conditions: 1 cycle at 95° C. for 5 minutes followed by 40 cycles with 95° C. for 45 seconds, 58° C. for 45 seconds and 72° C. for 2 minutes followed by a terminal cycle of 72° C. for 5 minutes and the following primers are used for the second PCR:

```
forward primer:
5'-gtcaactacgttggtggcttcgagtg-3'    SEQ ID NO: 420 reverse primer:
5'-ggtctagatcacttatcgtcatcatctttgt  SEQ ID NO: 421
agtccacgctggttctgcaggtctgc-3'
```

The PCR reactions are performed under addition of PCR grade betain to a final concentration of 1 M. Those PCRs generate two overlapping fragments, which are isolated and sequenced according to standard protocols using the PCR primers, and thereby provided a portion of the cDNA sequence coding macaque Endosialin from codon 9 of the leader peptide to codon 733 of the mature protein. To generate a construct for expression of macaque Endosialin a cDNA fragment is obtained by gene synthesis according to standard protocols (the cDNA and amino acid sequence of the construct is listed under SEQ ID Nos 422 and 423). In this construct the coding sequence of macaque Endosialin from amino acid 9 of the leader peptide to amino acid 733 of the mature protein, followed in frame by the coding sequence of amino acid 734 to the last amino acid of the mature human Endosialin protein, followed in frame by the coding sequence of a FLAG tag and a stop codon is fused in frame to the coding sequence of the amino acids 1 to 8 of the leader peptide of the human Endosialin protein. The gene synthesis fragment is also designed as to contain a Kozak site for eukaryotic expression of the construct and restriction sites at the beginning and the end of the fragment containing the cDNA. The introduced restriction sites, EcoRI at the 5' end and XbaI at the 3' end, are utilised in the following cloning procedures. The gene synthesis fragment is cloned via EcoRI and XbaI into a plasmid designated pEF-DHFR (pEF-DHFR is described in Raum et al. Cancer Immunol Immunother 50 (2001) 141-150) following standard protocols. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

8.16 Flow Cytometric Analysis of Cross-species Specificity of Bispecific Antibodies Directed at Membrane-proximal Target Epitopes of Human Endosialin In order to test the cross-species specificity of bispecific antibodies directed at membrane-proximal target epitopes of human Endosialin the capability of the constructs to bind to macaque Endosialin and macaque CD3, respectively, is investigated by FACS analysis. For this purpose the macaque Endosialin transfected CHO cells as described in example 8.15 and the macaque T cell line 4119LnPx (kindly provided by Prof Fickenscher, Hygiene Institute, Virology, Erlangen-Nuernberg; published in Knappe A, et al., and Fickenscher H., Blood 2000, 95, 3256-61) are used. 200,000 cells of the respective cell lines are incubated for 30 min on ice with 50 µl of cell culture supernatant of transfected cells expressing the cross-species specific bispecific antibody constructs. The cells are washed twice in PBS with 2% FCS and binding of the construct is detected with a murine Penta His antibody (Qiagen; diluted 1:20 in 50 µl PBS with 2% FCS). After washing, bound anti His antibodies are detected with an Fc gamma-specific antibody (Dianova) conjugated to phycoerythrin, diluted 1:100 in PBS with 2% FCS. Supernatant of untransfected cells is used as a negative control.

Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

9. Generation of Bispecific Single Chain Antibodies Directed at Membrane-proximal Target Epitopes of Human IGF-1R 9.1 Generation of CHO Cells Expressing Human IGF-1R The coding sequence of human IGF-1R as published in GenBank (Accession number NM_000875) is obtained by gene synthesis according to standard protocols. The gene synthesis fragment is designed as to contain first a Kozak site for eukaryotic expression of the construct followed by the coding sequence of the human IGF-1R protein and a stop codon (the cDNA and amino acid sequence of the construct is listed under SEQ ID Nos 424 and 425). The gene synthesis fragment is also designed as to introduce restriction sites at the beginning and at the end of the fragment. The introduced restriction sites, EcoRI at the 5' end and SalI at the 3' end, are utilized in the following cloning procedures. An internal restriction site is removed by silent mutation of the coding sequence in the gene synthesis fragment (BspEl: nucleotide 18 from A to C). The gene synthesis fragment is cloned via EcoRI and SalI into a plasmid designated pEF-DHFR (pEF-DHFR is described in Raum et al. Cancer Immunol Immunother 50 (2001) 141-150) following standard protocols. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

9.2 Generation of a Soluble Human IGF-1R Fusion Protein

The modified coding sequence of human IGF-1R as described in Example 9.1 is used for the construction of an artificial cDNA sequence encoding a soluble fusion protein of human IGF-1R and murine IgG1 Fc. To generate a construct for expression of the soluble human IGF-1R fusion protein a cDNA fragment is obtained by gene synthesis according to standard protocols (the cDNA and amino acid sequence of the construct is listed under SEQ ID Nos 426 and 427). The gene synthesis fragment is designed as to contain first a Kozak site for eukaryotic expression of the construct followed by the coding sequence of the human IGF-1R protein from amino acid 1 to 935 corresponding to the signal peptide and extracellular domains of human IGF-1R, followed in frame by the coding sequence of an artificial $Ser_1$-$Gly_4$-$Ser_1$-linker, followed in frame by the coding sequence of the hinge region and Fc gamma portion of murine IgG1, followed in frame by the coding sequence of a 6 histidine tag and a stop codon. The gene synthesis fragment is also designed as to introduce restriction sites at the beginning and at the end of the fragment. The introduced restriction sites, EcoRI at the 5' end and SalI at the 3' end, are utilized in the following cloning procedures. The gene synthesis fragment is cloned via EcoRI and SalI into a plasmid designated pEF-DHFR (pEF-DHFR is described in Raum et al. Cancer Immunol Immunother 50 (2001) 141-150) following standard protocols. The aforementioned procedures are all carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX. After two passages of stationary culture the cells are grown in roller bottles with nucleoside-free HyQ PF CHO liquid soy medium (with 4.0 mM L-Glutamine with 0.1% Pluronic F-68; HyClone) for 7 days before harvest. The cells are removed by centrifugation and the supernatant containing the expressed protein is stored at −20° C. Alternatively a clone of the expression plasmid with sequence-verified nucleotide sequence is used for transfection and protein expression in the FreeStyle 293 Expression System (Invitrogen GmbH, Karlsruhe, Germany) according to the manufacturer's protocol. Supernatant containing the expressed protein is obtained, cells are removed by centrifugation and the supernatant is stored at −20° C. For purification of the soluble human IGF-1R fusion protein a goat anti-mouse Fc affinity column is prepared according to standard protocols using a commercially available affinity purified goat anti-mouse IgG Fc fragment specific antibody with minimal cross-reaction to human, bovine and horse serum proteins (Jackson ImmunoResearch Europe Ltd.). Using this affinity column the fusion protein is isolated out of cell culture supernatant on an Äkta Explorer System (GE Amersham) and eluted by citric acid. The eluate is neutralized and concentrated.

9.3 Generation of CHO Cells Expressing Murine IGF-1R

The sequence of murine IGF-1R(NM_010513 Mus musculus insulin-like growth factor I receptor (Igf1 r), mRNA, National Center for Biotechnology Information, http://www.ncbi.nlm.nih.gov/entrez) is used to obtain a synthetic cDNA molecule by gene synthesis according to standard protocols. The gene synthesis fragment is designed as to contain the coding sequence of an immunoglobulin heavy chain leader comprising a start codon embedded within a Kozak consensus sequence, followed in frame by the coding sequence of a FLAG tag, followed in frame by the complete coding sequence of mature murine IGF-1R (the cDNA and amino acid sequence of the construct is listed under SEQ ID Nos 428 and 429). The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150). The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

9.4 Generation of CHO Cells Expressing a Mutated Human IGF-1R Antigen with Murine Membrane-distal Epitopes The coding sequence of a mutated human IGF-1R antigen with murine membrane-distal epitopes is obtained by gene synthesis according to standard protocols. The gene synthesis fragment is designed as to contain the coding sequence of an immunoglobulin heavy chain leader comprising a start codon embedded within a Kozak consensus sequence, followed in frame by the coding sequence of a FLAG tag, followed in frame by the coding sequence of the L1 domain and the cysteine-rich domain of mature murine IGF-1R followed in frame by human IGF-1R from the L2 domain to the stop codon (the cDNA and amino acid sequence of the construct is listed under SEQ ID Nos 430 and 431). The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150). The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

9.5 Generation of CHO Cells Expressing a Mutated Murine IGF-1R Antigen with Human Membrane-distal Epitopes The coding sequence of a mutated murine IGF-1R antigen with human membrane-distal epitopes is obtained by gene synthesis according to standard protocols. The gene synthesis fragment is designed as to contain the coding sequence of an immunoglobulin heavy chain leader comprising a start codon embedded within a Kozak consensus sequence, followed in frame by the coding sequence of a FLAG tag, followed in frame by the L1 domain and the cysteine-rich domain of mature human IGF-1R followed in frame by murine IGF-1R from the L2 domain to the stop codon (the cDNA and amino acid sequence of the construct is listed under SEQ ID Nos 432 and 433). The gene synthesis fragment is also designed as to introduce restriction sites at the 5' end (EcoRI) and at the 3' end (Sal I) of the cDNA fragment for cloning into the mammalian cell expression vector pEF-DHFR (pEF-DHFR is described in Raum et al. Cancer Immunol Immunother 50 (2001) 141-150). The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification for increased antigen expression is induced by increasing concentrations of methotrexate (MTX) to a final concentration of up to 20 nM MTX.

9.6 Immunization of Mice Using a Soluble Human IGF-1R Fusion Protein

Twelve weeks old F1 mice from BALB/c×C57BL/6 crossings are immunized with the soluble human IGF-1R fusion protein as described in Example 9.2. To this end for each animal 40 μg of the soluble human IGF-1R fusion protein are mixed with 10 nmol of a thioate-modified CpG-Oligonucleotide (5'-tccatgacgttcctgatgct-3') in 300 μl PBS and are injected intraperitoneally. Mice receive booster immunizations after 21, 42 and optionally 63 days in the same way. Ten days after the first booster immunization, blood samples are taken and antibody serum titers against human IGF-1R are tested by flow cytometry according to standard protocols. To this end 200,000 cells of the human IGF-1R transfected CHO cells as described in Example 9.1 are incubated for 30 min on ice with 50 μl of serum of the immunized animals diluted 1:1000 in PBS with 2% FCS. The cells are washed twice in PBS with 2% FCS and binding of serum antibodies is detected with an mouse Fc gamma-specific antibody (Dianova) conjugated to phycoerythrin, diluted 1:100 in PBS with 2% FCS. Serum of the animals obtained prior to immunization is used as a negative control. Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

Animals demonstrating significant serum reactivity against human IGF-1R as determined by the FACS analysis are used in the subsequent experiment.

9.7 Generation of an Immune Murine Antibody Scfv Library: Construction of a Combinatorial Antibody Library and Phage Display Three days after the last booster immunization spleen cells of reactive animals are harvested for the preparation of total RNA according to standard protocols.

A library of murine immunoglobulin (Ig) light chain (kappa) variable region (VK) and Ig heavy chain variable region (VH) DNA-fragments is constructed by RT-PCR on murine spleen RNA using VK- and VH specific primers. cDNA is synthesized according to standard protocols, see example 2.7.

450 ng of the kappa light chain fragments (SacI-SpeI digested) are ligated with 1400 ng of the phagemid pComb3H5Bhis (SacI-SpeI digested; large fragment). The resulting combinatorial antibody library is then transformed into 300 μl of electrocompetent *Escherichia coli* XL1 Blue cells by electroporation (2.5 kV, 0.2 cm gap cuvette, 25 μFD, 200 Ohm, Biorad gene-pulser) resulting in a library size of more than $10^7$ independent clones. After one hour of phenotype expression, positive transformants are selected for carbenicillin resistance encoded by the pComb3H5BHis vector in 100 ml of liquid super broth (SB)-culture over night. Cells are then harvested by centrifugation and plasmid preparation is carried out using a commercially available plasmid preparation kit (Qiagen).

2800 ng of this plasmid-DNA containing the VK-library (XhoI-BstEII digested; large fragment) are ligated with 900 ng of the heavy chain V-fragments (XhoI-BstEII digested) and again transformed into two 300 μl aliquots of electrocompetent *E. coli* XL1 Blue cells by electroporation (2.5 kV, 0.2 cm gap cuvette, 25 μFD, 200 Ohm) resulting in a total VH-VK scFv (single chain variable fragment) library size of more than $10^7$ independent clones.

After phenotype expression and slow adaptation to carbenicillin, the *E. coli* cells containing the antibody library are transferred into SB-Carbenicillin (SB with 50 μg/mL carbenicillin) selection medium. The *E. coli* cells containing the antibody library are then infected with an infectious dose of $10^{12}$ particles of helper phage VCSM13 resulting in the production and secretion of filamentous M13 phage, wherein each phage particle contains single stranded pComb3H5BHis-DNA encoding a murine scFv-fragment and displays the corresponding scFv-protein as a translational fusion to phage coat protein III. This pool of phages displaying the antibody library is later used for the selection of antigen binding entities.

9.8 Phage Display Based Selection of Membrane-proximal Target Binders on CHO Cells Expressing the Mutated Human IGF-1R Antigen with Murine Membrane-distal Epitopes The phage library carrying the cloned scFv-repertoire is harvested from the respective culture supernatant by PEG8000/NaCl precipitation and centrifugation. Approximately $10^{11}$ to $10^{12}$ scFv phage particles are resuspended in 0.4 ml of PBS/0.1% BSA and incubated with $10^5$ to $10^7$ CHO cells expressing the mutated human IGF-1R antigen with murine membrane-distal epitopes as described in example 9.4 for 1 hour on ice under slow agitation. These CHO cells are grown beforehand, harvested by centrifugation, washed in PBS and resuspended in PBS/1% FCS (containing Na Azide). scFv phage which do not specifically bind to the CHO cells are eliminated by up to five washing steps with PBS/1% FCS (containing Na Azide). After washing, binding entities are eluted from the cells by resuspending the cells in HCl-glycine pH 2.2 (10 min incubation with subsequent vortexing) and after neutralization with 2 M Tris pH 12, the eluate is used for infection of a fresh uninfected *E. coli* XL1 Blue culture (OD600>0.5). The *E. coli* culture containing *E. coli* cells successfully transduced with a phagemid copy, encoding a murine scFv-fragment, are again selected for carbenicillin resistance and subsequently infected with VCMS13 helper phage to start the second round of antibody display and in vitro selection. Typically a total of 4 to 5 rounds of selections are carried out.

9.9 Screening for Membrane-proximal Target Binders on CHO Cells Expressing the Human IGF-1R Antigen, the Murine IGF-1R Antigen and the Mutated Murine IGF-1R Antigen with Human Membrane-distal Epitopes Plasmid DNA corresponding to 4 and 5 rounds of panning is isolated from *E. coli* cultures after selection. For the production of soluble scFv-protein, VH-VL-DNA fragments are excised from the plasmids (XhoI-SpeI). These fragments are cloned via the same restriction sites in the plasmid pComb3H5BFlag/His differing from the original pComb3H5BHis in that the expression construct (e.g. scFv) includes a Flag-tag (TGDYKDDDDK) between the scFv and the His6-tag and the additional phage proteins are deleted. After ligation, each pool (different rounds of panning) of plasmid DNA is transformed into 100 µl heat shock competent *E. coli* TG1 or XLI blue and plated onto carbenicillin LB-agar. Single colonies are picked into 100 µl of LB carb (LB with 50 µg/ml carbenicillin).

After induction with 1 mM IPTG *E. coli* transformed with pComb3H5BFlag/His containing a VL- and VH-segment produce soluble scFv in sufficient amounts. Due to a suitable signal sequence, the scFv is exported into the periplasma where it folds into a functional conformation.

Single *E. coli* bacterial colonies from the transformation plates are picked for periplasmic small scale preparations and grown in SB-medium (e.g. 10 ml) supplemented with 20 mM $MgCl_2$ and carbenicillin 50 µg/ml (and re-dissolved in PBS (e.g. 1 ml) after harvesting. A temperature shock is applied by four rounds of freezing at −70° C. and thawing at 37° C. whereby the outer membrane of the bacteria is destroyed and the soluble periplasmic proteins including the scFvs are released into the supernatant. After elimination of intact cells and cell-debris by centrifugation, the supernatant containing the murine anti-human IGF-1R-scFvs is collected and used for further examination.

Screening of the isolated scFvs for membrane-proximal target binders is performed by flow cytometry on CHO cells expressing the human IGF-1R antigen as described in Example 9.1, the murine IGF-1R antigen as described in Example 9.3 and the mutated murine IGF-1R antigen with human membrane-distal epitopes as described in Example 9.5.

For flow cytometry $2.5 \times 10^5$ cells of the respective cell lines are incubated with 50 µl supernatant. The binding of the constructs is detected with an anti-His antibody (Penta-His Antibody, BSA free, Qiagen GmbH, Hilden, FRG) at 2 µg/ml in 50 µl PBS with 2% FCS. As a second step reagent a R-Phycoerythrin-conjugated affinity purified F(ab')2 fragment, goat anti-mouse IgG (Fc-gamma fragment specific), diluted 1:100 in 50 µl PBS with 2% FCS (Dianova, Hamburg, FRG) is used. The samples are measured on a FACSscan (BD biosciences, Heidelberg, FRG).

Only constructs which show binding to CHO cells expressing the human IGF-1R antigen and do not show binding to CHO cells expressing the murine IGF-1R antigen and also do not show binding to CHO cells expressing the mutated murine IGF-1R antigen with human membrane-distal epitopes are selected for further use.

9.10 Generation of Human/Humanized Equivalents of Non-human scFvs to Membrane-proximal Target Epitopes of Human Igf-1R The VH region of a murine anti-IGF-1R scFv to a membrane-proximal target epitope of human IGF-1R is aligned against human antibody germline amino acid sequences. The human antibody germline VH sequence is chosen which has the closest homology to the non-human VH and a direct alignment of the two amino acid sequences is performed. There are a number of framework residues of the non-human VH that differ from the human VH framework regions ("different framework positions"). Some of these residues may contribute to the binding and activity of the antibody to its target.

To construct a library that contains the murine CDRs and at every framework position that differs from the chosen human VH sequence both possible residues (the human and the maternal murine amino acid residue), degenerated oligonucleotides are synthesized. These oligonucleotides incorporate at the differing positions the human residue with a probability of 75% and the murine residue with a probability of 25%. For one human VH e.g. six of these oligonucleotides have to be synthesized that overlap in a terminal stretch of approximately 20 nucleotides. To this end every second primer is an antisense primer. Restriction sites within the oligonucleotides needed for later cloning are deleted.

These primers may have a length of 60 to 90 nucleotides, depending on the number of primers that are needed to span over the whole V sequence.

These e.g. six primers are mixed in equal amounts (e.g. 1 µl of each primer (primer stocks 20 to 100 µM) to a 20 µl PCR reaction) and added to a PCR mix consisting of PCR buffer, nucleotides and Taq polymerase. This mix is incubated at 94° C. for 3 minutes, 65° C. for 1 minute, 62° C. for 1 minute, 59° C. for 1 minute, 56° C. for 1 minute, 52° C. for 1 minute, 50° C. for 1 minute and at 72° C. for 10 minutes in a PCR cycler. Subsequently the product is run in an agarose gel electrophoresis and the product of a size from 200 to 400 base pairs isolated from the gel according to standard methods.

This PCR product is then used as a template for a standard PCR reaction using primers that incorporate suitable N-terminal and C-terminal cloning restriction sites. The DNA fragment of the correct size (for a VH approximately 350 nucleotides) is isolated by agarose gel electrophoresis according to standard methods. In this way sufficient VH DNA fragment is amplified. This VH fragment is now a pool of VH fragments that have each one a different amount of human and murine residues at the respective differing framework positions (pool of humanized VH). The same procedure is performed for the VL region of the murine anti-IGF-1R scFv to a membrane-proximal target epitope of human IGF-1R (pool of humanized VL).

The pool of humanized VH is then combined with the pool of humanized VL in the phage display vector pComb3H5Bhis to form a library of functional scFvs from which—after display on filamentous phage—anti-IGF-1R binders to membrane-proximal target epitopes of human IGF-1R are selected, screened, identified and confirmed as described above for the parental non-human (murine) anti-IGF-1R scFv. Single clones are then analyzed for favorable properties and amino acid sequence. Those scFvs, which are closest in amino acid sequence homology to human germline V-segments, are preferred.

Human/humanized anti-IGF-1R scFvs to membrane-proximal target epitopes of human IGF-1R are converted into recombinant bispecific single chain antibodies and further characterized as follows.

9.11 Generation of I2C-based Bispecific Single Chain Antibodies Directed at Membrane-proximal Target Epitopes of Human IGF-1R Anti-IGF-1R scFvs to membrane-proximal target epitopes of human IGF-1R with favorable properties and amino acid sequence are converted into recombinant bispecific single chain antibodies by joining them via a $Gly_4Ser_1$-linker with the CD3 specific scFv 120 (SEQ ID) to result in constructs with the domain arrangement $VH_{IGF-1R}$-$(Gly_4Ser_1)_3$-$VL_{IGF-1R}$-$Ser_1Gly_4Ser_1$-$VH_{CD3}$-$(Gly_4Ser_1)_3$-$VL_{CD3}$.

I2C-based bispecific single chain antibodies directed at membrane-proximal target epitopes of human IGF-1R were designed as set out in the following Table 8:

TABLE 8

Formats of I2C-based bispecific single chain antibodies directed at membrane-proximal target epitopes of human IGF-1R

| SEQ ID (nucl/prot) | Formats of protein constructs (N → C) |
|---|---|
| 848/847 | IGF1R12HLxI2CHL |
| 862/861 | IGF1R24HLxI2CHL |

Alternatively further constructs with different domain arrangements can be generated according to standard protocols. For expression in CHO cells the coding sequences of (i) an N-terminal immunoglobulin heavy chain leader comprising a start codon embedded within a Kozak consensus sequence and (ii) a C-terminal His6-tag followed by a stop codon are both attached in frame to the nucleotide sequence encoding the bispecific single chain antibodies prior to insertion of the resulting DNA-fragment as obtained by gene synthesis into the multiple cloning site of the expression vector pEF-DHFR (Raum et al. Cancer Immunol Immunother 50 (2001) 141-150). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

9.12 Expression and Purification of Bispecific Single Chain Antibody Molecules Directed at Membrane-proximal Target Epitopes of Human IGF-1R Bispecific single chain antibody molecules are expressed in Chinese hamster ovary cells (CHO). Eukaryotic protein expression in DHFR deficient CHO cells is performed as described by Kaufmann R. J. (1990) Methods Enzymol. 185, 537-566. Gene amplification of the constructs is induced by addition of increasing concentrations of MTX up to final concentrations of 20 nM MTX. After two passages of stationary culture cell culture supernatant is collected and used in the subsequent experiments. To generate supernatant for purification after two passages of stationary culture the cells are grown in roller bottles with nucleoside-free HyQ PF CHO liquid soy medium (with 4.0 mM L-Glutamine with 0.1% Pluronic F-68; HyClone) for 7 days before harvest. The cells are removed by centrifugation and the supernatant containing the expressed protein is stored at −20° C. Alternatively, constructs are transiently expressed in HEK 293 cells. Transfection is performed with 293fectin reagent (Invitrogen, #12347-019) according to the manufacturer's protocol. Furthermore the constructs are alternatively expressed in transiently transfected DHFR deficient CHO cells using for example FuGENE® HD Transfection Reagent (Roche Diagnostics GmbH, Cat. No. 04709691001) according to the manufacturer's protocol.

Äkta® Explorer System (GE Health Systems) and Unicorn® Software are used for chromatography. Immobilized metal affinity chromatography ("IMAC") is performed using a Fractogel EMD Chelate® (Merck) which is loaded with $ZnCl_2$ according to the protocol provided by the manufacturer. The column is equilibrated with buffer A (20 mM sodium phosphate buffer pH 7.2, 0.1 M NaCl) and the cell culture supernatant (500 ml) is applied to the column (10 ml) at a flow rate of 3 ml/min. The column is washed with buffer A to remove unbound sample. Bound protein is eluted using a two step gradient of buffer B (20 mM sodium phosphate buffer pH 7.2, 0.1 M NaCl, 0.5 M Imidazole) according to the following procedure:

Step 1: 20% buffer B in 6 column volumes
Step 2: 100% buffer B in 6 column volumes Eluted protein fractions from step 2 are pooled for further purification. All chemicals are of research grade and purchased from Sigma (Deisenhofen) or Merck (Darmstadt).

Gel filtration chromatography is performed on a HiLoad 16/60 Superdex 200 prep grade column (GE/Amersham) equilibrated with Equi-buffer (25 mM Citrate, 200 mM Lysine, 5% Glycerol, pH 7.2). Eluted protein samples (flow rate 1 ml/min) are subjected to standard SDS-PAGE and Western Blot for detection. Prior to purification, the column is calibrated for molecular weight determination (molecular weight marker kit, Sigma MW GF-200). Protein concentrations are determined using OD280 nm.

Purified bispecific single chain antibody protein is analyzed in SDS PAGE under reducing conditions performed with pre-cast 4-12% Bis Tris gels (Invitrogen). Sample preparation and application are performed according to the protocol provided by the manufacturer. The molecular weight is determined with MultiMark protein standard (Invitrogen). The gel is stained with colloidal Coomassie (Invitrogen protocol). The purity of the isolated protein is typically >95% as determined by SDS-PAGE.

The bispecific single chain antibody has a molecular weight of about 52 kDa under native conditions as determined by gel filtration in PBS.

Western Blot is performed using an Optitran® BA-S83 membrane and the Invitrogen Blot Module according to the protocol provided by the manufacturer. The antibody used is directed against the His Tag (Penta His, Qiagen) and a Goat-anti-mouse Ig labeled with alkaline phosphatase (AP) (Sigma) is used as second step reagent, and BCIP/NBT (Sigma) as substrate. A band detected at 52 kD corresponds to purified bispecific single chain antibodies.

9.13 Flow Cytometric Binding Analysis of Bispecific Antibodies Directed at Membrane-proximal Target Epitopes of Human IGF-1R In order to test the functionality of bispecific antibody constructs regarding the capability to bind to CD3 and to membrane-proximal target epitopes of human IGF-1R, respectively, a FACS analysis is performed. For this purpose CHO cells transfected with human IGF-1R as described in Example 9.1 and the human CD3 positive T cell leukemia cell line HPB-ALL (DSMZ, Braunschweig, ACC483) are used. For confirmation of binding to membrane-proximal target epitopes of human IGF-1R—in addition—CHO cells expressing the murine IGF-1R antigen as described in Example 9.3, CHO cells expressing the mutated human IGF-1R antigen with murine membrane-distal epitopes as described in Example 9.4 and CHO cells expressing the mutated murine IGF-1R antigen with human membrane-distal epitopes as described in Example 9.5 are used. 200,000 cells of the respective cell lines are incubated for 30 min on ice with 50 µl of cell culture supernatant of transfected cells expressing the bispecific antibody constructs. The cells are washed twice in PBS with 2% FCS and binding of the construct is detected with a murine Penta His antibody (Qiagen; diluted 1:20 in 50 µl PBS with 2% FCS). After washing, bound anti His antibodies are detected with an Fc gamma-specific antibody (Dianova) conjugated to phycoerythrin, diluted 1:100 in PBS with 2% FCS. Supernatant of untransfected cells is used as a negative control.

Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

Only those constructs that show bispecific binding to human CD3 as well as to human IGF-1R and neither bind to the murine IGF-1R antigen nor to the mutated murine IGF-1R antigen with human membrane-distal epitopes are selected for further use.

Figure 17:
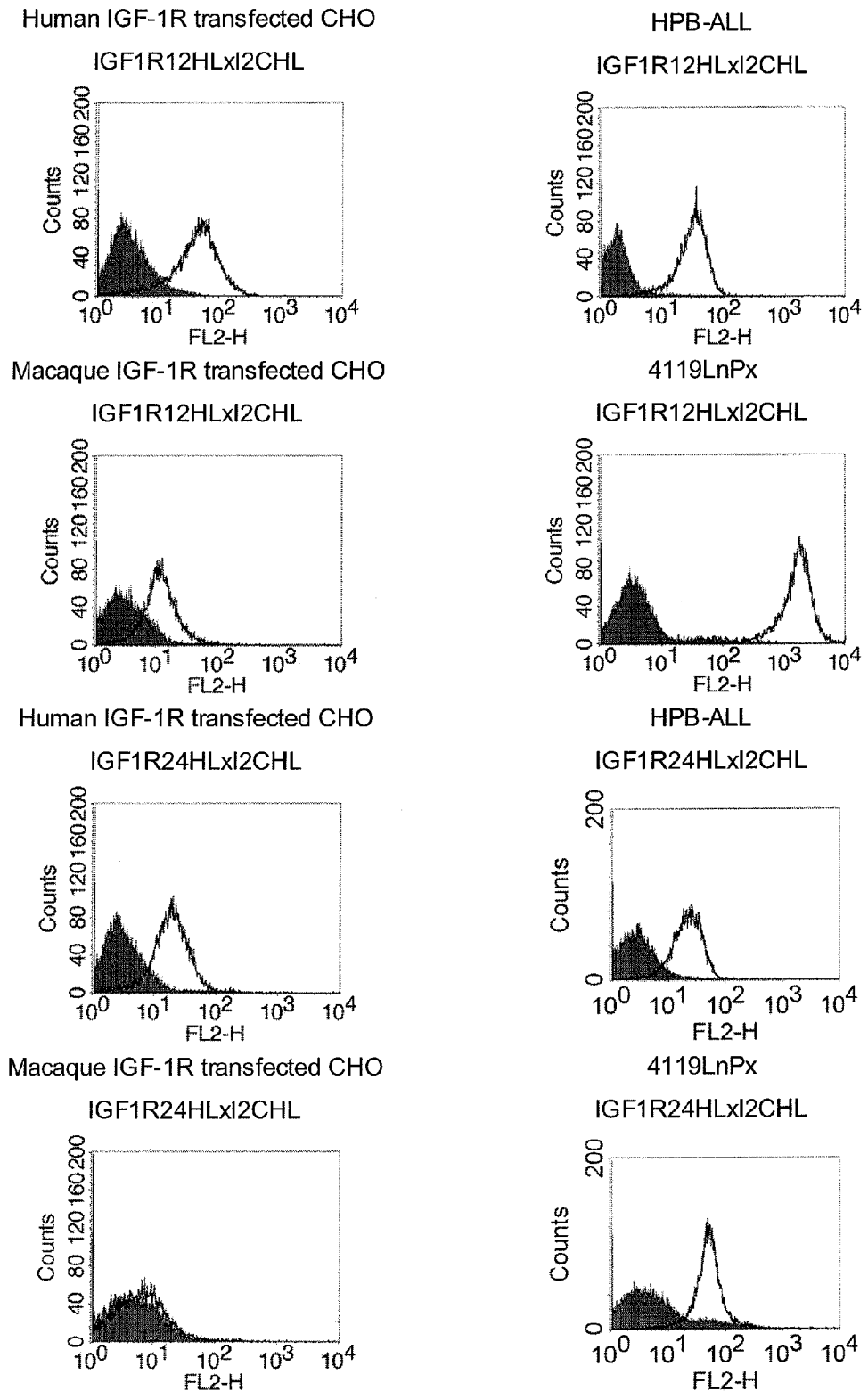
Figure 18:
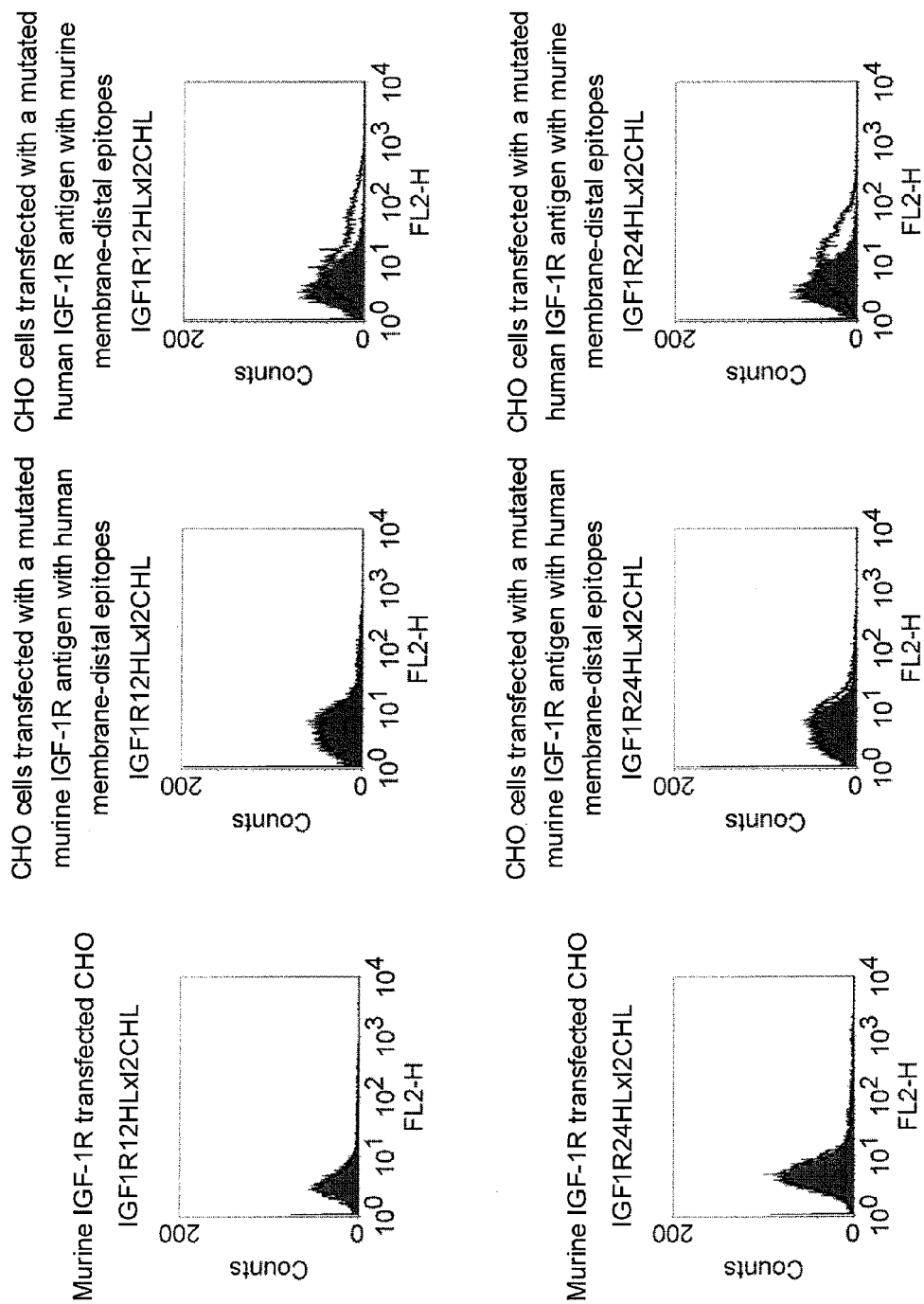
Figure 19:
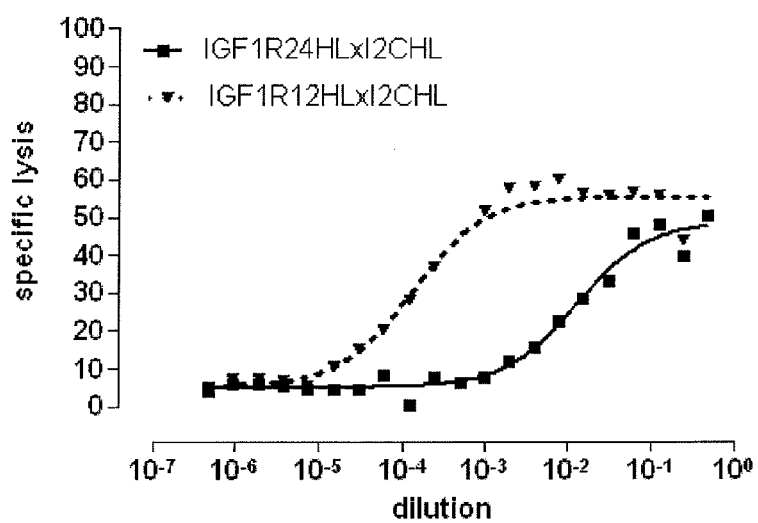

The bispecific binding of the single chain molecules listed above was clearly detectable as shown in FIG. 17. In the FACS analysis all constructs showed binding to human CD3 and human IGF-1R compared to the negative control. Membrane-proximal target binding of the single chain molecules listed above was clearly detectable as shown in FIG. 19. In the FACS analysis all constructs showed binding to the mutated human IGF-1R antigen with murine membrane-distal epitopes and did not show binding to the murine IGF-1R antigen and did also not show binding to the mutated murine IGF-1R antigen with human membrane-distal epitopes as compared to the negative control.

9.14 Bioactivity of Bispecific Antibodies Directed at Membrane-proximal Target Epitopes of Human IGF-1R Bioactivity of generated bispecific single chain antibodies is analyzed by chromium 51 ($^{51}$Cr) release in vitro cytotoxicity assays using the CHO cells transfected with human IGF-1R described in Example 9.1. As effector cells stimulated human CD4/CD56 depleted PBMC are used.

Stimulated human PBMC are obtained as follows:

A Petri dish (145 mm diameter, Greiner bio-one GmbH, Kremsmünster) is coated with a commercially available anti-CD3 specific antibody (e.g. OKT3, Orthoclone) in a final concentration of 1 μg/ml for 1 hour at 37° C. Unbound protein is removed by one washing step with PBS. The fresh PBMC are isolated from peripheral blood (30-50 ml human blood) by Ficoll gradient centrifugation according to standard protocols. 3-5×10$^7$ PBMC are added to the precoated petri dish in 120 ml of RPMI 1640 with stabilized glutamine/10% FCS/IL-2 20 U/ml (Proleukin, Chiron) and stimulated for 2 days. On the third day the cells are collected and washed once with RPMI 1640. IL 2 is added to a final concentration of 20 U/ml and the cells are cultivated again for one day in the same cell culture medium as above.

By depletion of CD4+ T cells and CD56+ NK cells according to standard protocols CD8+ cytotoxic T lymphocytes (CTLs) are enriched.

Target cells are washed twice with PBS and labeled with 11.1 MBq $^{51}$Cr in a final volume of 100 μl RPMI with 50% FCS for 60 minutes at 37° C. Subsequently the labeled target cells are washed 3 times with 5 ml RPMI and then used in the cytotoxicity assay. The assay is performed in a 96 well plate in a total volume of 250 μl supplemented RPMI (as above) with an E:T ratio of 10:1. Supernatant of cells expressing the bispecific single chain antibody molecules in a final concentration of 50% and 20 twofold dilutions thereof are applied. The assay time is 18 hours. Cytotoxicity is measured as relative values of released chromium in the supernatant related to the difference of maximum lysis (addition of Triton-X) and spontaneous lysis (without effector cells). All measurements are done in quadruplicates. Measurement of chromium activity in the supernatants is performed with a Wizard® 3" gammacounter (Perkin Elmer Life Sciences GmbH, Koln, Germany). Analysis of the experimental data is performed with Prism 4 for Windows® (version 4.02, GraphPad Software Inc., San Diego, Calif., USA). Sigmoidal dose response curves typically have $R^2$ values >0.90 as determined by the software.

Only those constructs showing potent recruitment of cytotoxic activity of effector T cells against target cells positive for IGF-1R are selected for further use.

9.15 Generation of CHO Cells Expressing Macaque IGF-1R

The coding sequence of macaque IGF-1R as published in Gen Bank (Accession number XM_001100407) is obtained by gene synthesis according to standard protocols. The gene synthesis fragment is designed as to contain first a Kozak site for eukaryotic expression of the construct followed by the coding sequence of the macaque IGF-1R protein and a stop codon (the cDNA and amino acid sequence of the construct is listed under SEQ ID Nos 434 and 435). The gene synthesis fragment is also designed as to introduce restriction sites at the beginning and at the end of the fragment. The introduced restriction sites, EcoRI at the 5' end and SalI at the 3' end, are utilized in the following cloning procedures. The gene synthesis fragment is cloned via EcoRI and SalI into a plasmid designated pEF-DHFR (pEF-DHFR is described in Raum et al. Cancer Immunol Immunother 50 (2001) 141-150) following standard protocols. The aforementioned procedures are carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

9.16 Flow Cytometric Analysis of Cross-species Specificity of Bispecific Antibodies Directed at Membrane-proximal Target Epitopes of Human IGF-1R In order to test the cross-species specificity of bispecific antibodies directed at membrane-proximal target epitopes of human IGF-1R the capability of the constructs to bind to macaque IGF-1R and macaque CD3, respectively, is investigated by FACS analysis. For this purpose the macaque IGF-1R transfected CHO cells as described in example 9.15 and the macaque T cell line 4119LnPx (kindly provided by Prof Fickenscher, Hygiene Institute, Virology, Erlangen-Nuernberg; published in Knappe A, et al., and Fickenscher H., Blood 2000, 95, 3256-61) are used. 200,000 cells of the respective cell lines are incubated for 30 min on ice with 50 μl of cell culture supernatant of transfected cells expressing the cross-species specific bispecific antibody constructs. The cells are washed twice in PBS with 2% FCS and binding of the construct is detected with a murine Penta His antibody (Qiagen; diluted 1:20 in 50 μl PBS with 2% FCS). After washing, bound anti His antibodies are detected with an Fc gamma-specific antibody (Dianova) conjugated to phycoerythrin, diluted 1:100 in PBS with 2% FCS. Supernatant of untransfected cells is used as a negative control. Flow cytometry is performed on a FACS-Calibur apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

The cross-species specific binding of the single chain molecules listed above was clearly detectable as shown in FIG. 17. In the FACS analysis all constructs showed binding to macaque CD3 and macaque IGF-1R compared to the negative control. Human/humanized equivalents of scFvs specific for IGF-1R contained in the bispecific single chain molecules are generated as described herein. Cloning of binding molecules based on these human/humanized scFvs and expression and purification of these bispecific single chain molecules is performed as described above. Flow cytometric analysis of bispecific binding and analysis of bioactivity by chromium 51 (51Cr) release in vitro cytotoxicity assays is performed as described above. Based on demonstrated bispecific binding and recruited cytotoxicity binding molecules are selected for further use.

Example 10

10.1. Generation of PSMA- and CD3-directed Bispecific Single Chain Antibodies

Bispecific single chain antibodies comprising either scFv binding domain P7 against a PSMA-epitope with <60 Å membrane-distance or scFv binding domain D4 against a PSMA-epitope with ≥60 Å membrane-distance and the scFv binding domain I2C directed at CD3epsilon on human T cells were obained by gene synthesis. The gene synthesis fragments were designed as to contain first a Kozak site for eukaryotic expression of the construct, followed by a 19 amino acid immunoglobulin leader peptide, followed in frame by the coding sequence of the bispecific single chain antibody, followed in frame by the coding sequence of a 6 histidine tag and a stop codon. The variable region arrangements as well as the SEQ ID Nos of the cDNA- and amino acid sequences are listed in the table 9 below.

| SEQ ID (nucl/prot) | Formats of protein constructs (N → C) |
|---|---|
| 488/487 | PSMA-P7 HL x I2C HL |
| 474/473 | PSMA-D4 HL x I2C HL |

The gene synthesis fragments were also designed as to introduce suitable restriction sites at the beginning (EcoRI) and at the end of the fragment (Sal I) for cloning of the gene synthesis fragment into the mammalian cell expression vector pEF-DHFR (pEF-DHFR is described in Raum et al. Cancer Immunol Immunother 50 (2001) 141-150). The aforementioned procedures were carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX. After two passages of stationary culture cell culture supernatant was collected and used in the subsequent experiments.

10.2 Epitope Mapping of the PSMA- and CD3-Reactive Bispecific Single Chain Antibody Molecule PSMA-P7 HLxI2C HL A PSMA-epitope with <60 Å membrane-distance of bispecific single chain antibody PSMA-P7 HLxI2C HL was confirmed by epitope mapping using chimeric PSMA constructs.

10.2.1 Generation of CHO Cells Expressing Human/Rat PSMA Chimeras

PSMA of *rattus norvegicus*, which is not bound by PSMA bispecific single chain antibody PSMA-P7 HLxI2C HL, was used for making chimeras with human PSMA. Thus, creating a chimera in the region containing the binding epitope of a PSMA bispecific single chain antibody leads to loss of binding of said bispecific single chain antibody to the respective PSMA construct.

The coding sequence of human PSMA as published in GenBank (Accession number NM_004476) and the coding sequence of rat PSMA (NM_057185, *Rattus norvegicus* folate hydrolase (Folh1), mRNA, National Center for Biotechnology Information, http://www.ncbi.nlm.nih.gov/entrez) were used for generation of the chimeric constructs.

A set of 6 chimeric cDNA constructs was designed and generated by gene synthesis according to standard protocols. In the constructs segments of the coding sequences for the amino acids 140 to 169, 281 to 284, 300 to 344, 589 to 617, 683 to 690 and 716 to 750, respectively, were exchanged for the homologous sequences of rat PSMA.

Chimeric PSMA constructs were generated as described above and designated as set out in the following Table 10:

TABLE 10

Designation of chimeric PSMA constructs

| SEQ ID (nucl/prot) | Designation |
|---|---|
| 461/462 | huPSMArat140-169 |
| 463/464 | huPSMArat281-284 |
| 465/466 | huPSMArat300-344 |
| 467/468 | huPSMArat598-617 |
| 469/470 | huPSMArat683-690 |
| 471/472 | huPSMArat716-750 |

The gene synthesis fragments were designed as to contain first a Kozak site for eukaryotic expression of the construct followed by the coding sequence of the chimeric PSMA proteins, followed in frame by the coding sequence of a FLAG-tag and a stop codon. The gene synthesis fragments were also designed as to introduce restriction sites at the beginning and at the end of the fragments. The introduced restriction sites, EcoRI at the 5' end and SalI at the 3' end, were utilized in the following cloning procedures. Undesirable internal restriction sites were removed by silent mutation of the coding sequence in the gene synthesis fragments. The gene synthesis fragments were cloned via EcoRI and SalI into a plasmid designated pEF-DHFR (pEF-DHFR is described in Raum et al. Cancer Immunol Immunother 50 (2001) 141-150) following standard protocols. The aforementioned procedures were carried out according to standard protocols (Sambrook, Molecular Cloning; A Laboratory Manual, 3rd edition, Cold Spring Harbour Laboratory Press, Cold Spring Harbour, N.Y. (2001)). A clone with sequence-verified nucleotide sequence was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX.

10.2.2 Flow Cytometric Binding Analysis for Epitope Mapping of the PSMA- and CD3-Reactive Bispecific Single Chain Antibody Molecule PSMA-P7 HLxI2C HL Using Chimeric PSMA Proteins In order to determine the binding epitope of the PSMA bispecific single chain antibody PSMA-P7 HLxI2C HL a FACS analysis was performed. For this purpose CHO cells transfected with human/rat chimeric PSMA molecules as described in Example 10.2.1 above were used. FACS analysis with supernatant of CHO cells expressing PSMA-P7 HLxI2C HL was performed as described herein. Detection of binding of PSMA-P7 HLxI2C HL was performed using a murine Penta His antibody and as second step reagent an Fc gamma-specific antibody conjugated to phycoerythrin. Supernatant of untransfected cells was used as a negative control. Supernatant of CHO cells expressing the bispecific single chain antibody construct PSMA-D4 HLxI2C HL cross-reactive with rat PSMA was used as control for expression of the chimeric PSMA constructs.

Figure 20A:
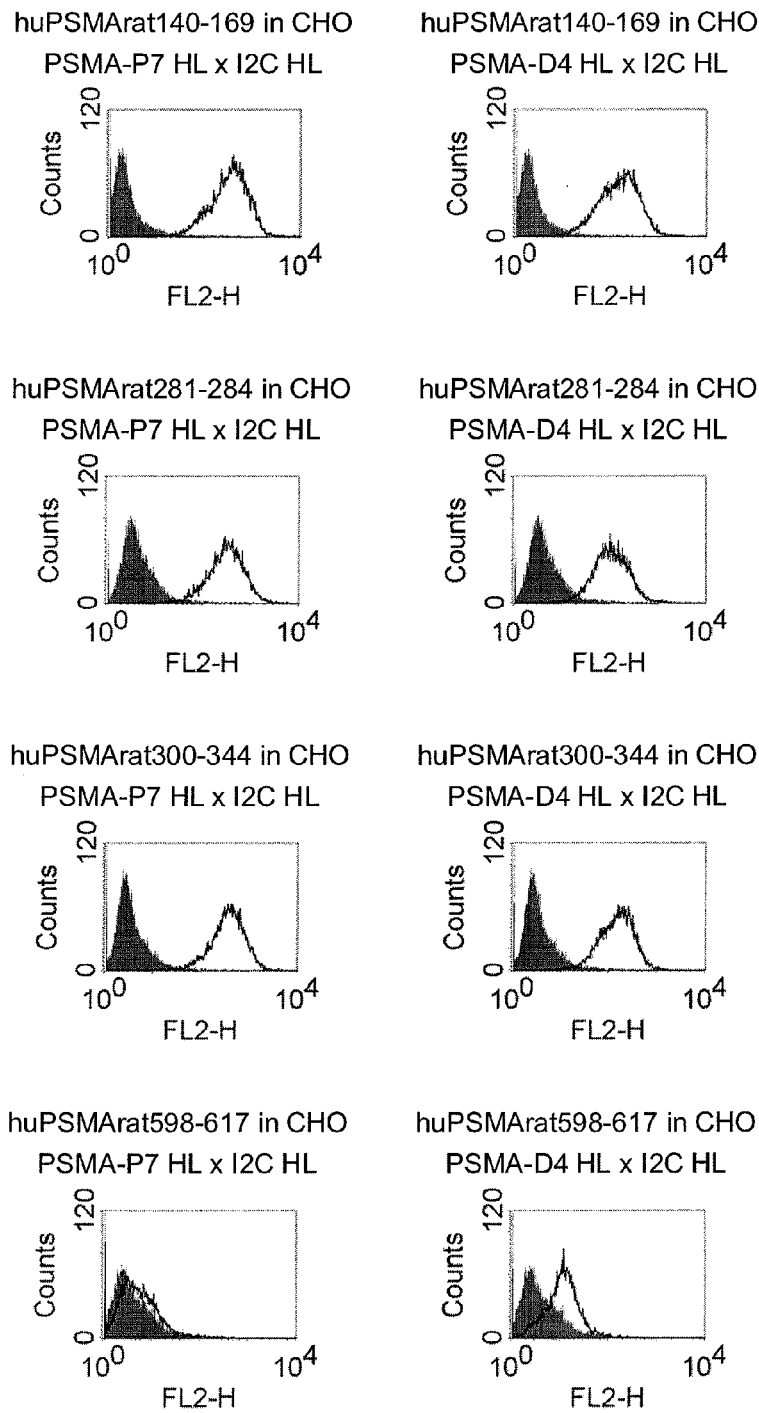
Figure 20B:
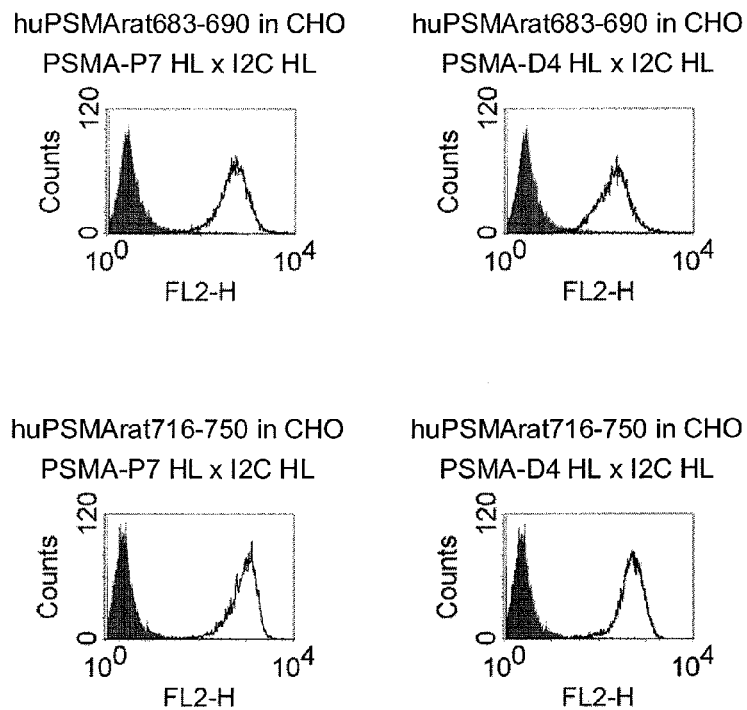

As shown in FIG. 20 both PSMA bispecific single chain antibodies, PSMA-P7 HLxI2C HL and PSMA-D4 HLxI2C HL, showed binding to the chimeric constructs huPSMArat140-169, huPSMArat281-284, huPSMArat300-344, huPSMArat683-690 and huPSMArat716-750. As furthermore shown in FIG. 20 there is a lack of binding for PSMA-P7 HLxI2C HL to the construct huPSMArat598-617, which demonstrates the presence of its binding epitope in the region of amino acids 598 to 617 of human PSMA.

As shown in Table 1 the amino acids 598 to 617 constitute a membrane proximal epitope as defined herein. In conclusion the results of the mapping based on chimeric PSMA constructs demonstrate that bispecific single-chain antibody PSMA-P7 HLxI2C HL recognizes a membrane-proximal target epitope of human PSMA with <60 Å membrane-distance as defined herein.

10.3 Epitope Mapping of the PSMA- and CD3-reactive Bispecific Single Chain Antibody Molecule PSMA-D4 HLxI2C HL A PSMA-epitope with ≥60 Å membrane-distance of bispecific single chain antibody PSMA-D4 HLxI2C HL was confirmed by epitope mapping using a peptide scanning approach. Peptide scanning uses overlapping peptides of a given protein and analyses antibody binding to immobilized peptides by enzyme-linked immunosorbent assays (ELISAs). The epitope mapping experiments with the PSMA bispecific single chain antibody PSMA-D4 HLxI2C HL were performed as described in detail in Bernard et al. 2004, J. Biol. Chem., 279: 24313-22 and Teeling et al. 2006, J. Immunol., 177: 362-71.

Figure 21:
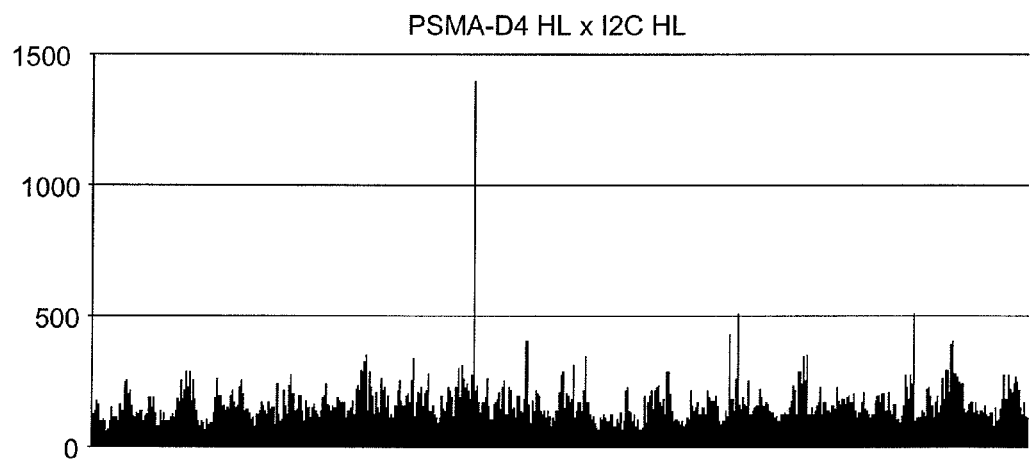

In brief, 693 different 15-mer peptides were synthesized that span the entire extracellular amino acid sequence of human PSMA and overlap with each neighboring 15-mer peptide by 14 amino acids. These peptides were coated to ELISA wells in a 384-well plate format. For this series of experiments, the anti-PSMA scFv fragment of bispecific single chain antibody PSMA-D4 HLxI2CHL was produced in E. coli and used for ELISA as crude periplasmic extracts prepared as described herein. The scFv antibody was incubated with the peptides and specific binding detected using an anti-His antibody. Binding signals were measured in a 384-well ELISA reader. As shown in the FIG. 21 a clear maximum signal was obtained for a peptide spanning over the amino acids threonine 334 to threonine 339, which demonstrates the presence of binding epitope of PSMA-D4 HLxI2CHL in the region of amino acids 334 to 339 of human PSMA. As shown in Table 1 threonine 334 and threonine 339 constitute a membrane-distal epitope as defined herein.

In conclusion the results of the mapping based on peptide scanning demonstrate that bispecific single-chain antibody PSMA-D4 HLxI2CHL recognizes a membrane-distal target epitope of human PSMA with 60 Å membrane-distance as defined herein.

10.4 Comparative Analysis of Cytotoxic Activity of Bispecific Antibodies Single-chain Antibodies Directed at Membrane-proximal and Membrane-distal Target Epitopes of Human PSMA Bioactivity of bispecific single chain antibodies was analyzed by a CytoTox-Glo™ cytotoxicity assay with unstimulated human PBMC using the CHO cells transfected with human PSMA described in Example 2.1. As effector cells unstimulated human PBMC were used.

Unstimulated human PBMC were obtained as follows:

Human peripheral blood mononuclear cells (PBMC) were prepared by Ficoll density gradient centrifugation from enriched lymphocyte preparations (buffy coats), a side product of blood banks collecting blood for transfusions. Buffy coats were supplied by a local blood bank and PBMC were prepared on the same day of blood collection. After Ficoll density centrifugation and extensive washes with Dulbecco's PBS (Gibco), remaining erythrocytes were removed from PBMC via incubation with erythrocyte lysis buffer (155 mM NH4Cl, 10 mM KHCO$_3$, 100 µM EDTA). Platelets were removed via the supernatant upon centrifugation of PBMC at 100×g. Remaining lymphocytes mainly encompass B and T lymphocytes, NK cells and monocytes. PBMC were kept in culture at 37° C. and 5% CO$_2$ in RPMI medium (Gibco) with 10% FBS (Gibco). All procedures were performed according to standard protocols (Current Protocols in Immunology; Coligan, Kruisbeek, Margulies, Shevach and Strober; Wiley-Interscience, 2002)

The CytoTox-Glo™ cytotoxicity assay (Kit from Promega) was used according to the instructions provided by the manufacturer.

Each measurement was performed in triplicates with defined dilution series of purified PSMA specific bispecific antibodies (0.001 ng/ml to 250 ng/ml) and appropriate controls to define spontaneous lysis (effector and target cells without bispecific antibodies) and maximum lysis (addition of detergent digitonin to cells). 10000/well target and 100000/well effector cells were mixed in a defined ratio with effector cells in excess (E:T ratio of 10:1). After incubation at 37° C. for 20-24 hours CytoTox-Glo cytotoxicity assay reagent (AAF-Glo™; part of the CytoTox-Glo Kit from Promega) was added to all wells. The cells and the reagent were mixed by orbital shaking and incubated at room temperature for 1 hour. Determination of the number of dead cells was performed subsequently by measuring luminescence with a plate reader (TECAN Spectrafluorometer). The measured signal correlates directly with the amount of lysed cells.

On the basis of those measured values the cytotoxicity values of every individual sample were calculated according to following formula:

$$S [\%] = (V-B)/(M-B)$$

Wherein S is specific toxicity, V is the measured value, B is the average of blank values and M is the average of maximum lysis.

Figure 22:
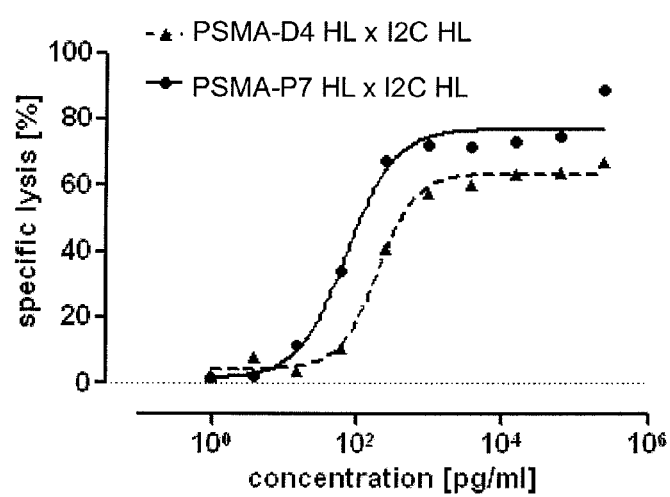

As shown in FIG. 22 the bispecific antibody PSMA-P7 HLxI2CHL directed at a membrane-proximal target epitope of human PSMA (as shown in Example 10.2) demonstrated superior cytotoxic activity against human PSMA positive target cells as compared to the bispecific single-chain antibody PSMA-D4 HLxI2CHL directed at membrane-distal target epitope of human PSMA (as shown in Example 10.3).

TABLE 1

| aa pos. | HUM | RAT | distance to aa of reference (Å) |
|---|---|---|---|
| 63 | D | Q | 11.7 |
| 79 | Q | R | 35.75 |
| 80 | I | T | 37.16 |
| 87 | E | Q | 40.16 |
| 88 | Q | H | 37.46 |
| 91 | Q | E | 33.93 |
| 97 | Q | H | 25.2 |
| 98 | S | A | 24.96 |
| 107 | S | L | 21.07 |
| 111 | A | S | 31.1 |
| 112 | H | D | 34.65 |
| 140 | N | K | 62.43 |
| 144 | F | A | 51.27 |
| 146 | P | L | 50.14 |
| 147 | P | S | 47.22 |
| 154 | V | I | 44.73 |
| 157 | I | V | 44.61 |
| 161 | F | Y | 48.85 |
| 169 | M | T | 62.96 |
| 191 | D | V | 68.07 |
| 207 | K | V | 46.97 |
| 225 | V | I | 56.52 |
| 236 | A | V | 45.34 |
| 258 | I | V | 46.85 |
| 281 | R | H | 50.31 |
| 282 | G | E | 52.65 |
| 283 | I | F | 52.92 |
| 284 | A | T | 55.82 |
| 300 | Y | D | 56.23 |
| 308 | K | H | 67.6 |
| 320 | R | K | 58.61 |
| 322 | S | G | 56.59 |
| 334 | T | A | 73.45 |
| 339 | T | K | 75.1 |
| 344 | M | L | 60.7 |
| 349 | T | Y | 52.3 |
| 351 | E | K | 48.1 |
| 363 | R | K | 15.8 |
| 380 | S | A | 35.47 |
| 401 | S | T | 11.76 |
| 408 | E | K | 7.93 |
| 438 | N | H | 31.19 |
| 471 | Y | H | 25.5 |
| 475 | H | Y | 23.2 |
| 482 | K | P | 20.44 |
| 495 | E | D | 27.54 |
| 498 | T | K | 30.45 |
| 499 | K | E | 33.18 |
| 504 | P | T | 38.15 |
| 507 | S | T | 35.93 |
| 542 | E | K | 42.23 |
| 543 | T | N | 42.97 |
| 546 | F | V | 43.56 |
| 548 | G | S | 39.02 |
| 569 | M | T | 28.15 |
| 582 | G | A | 14.07 |
| 598 | R | Q | 31.22 |
| 599 | D | S | 30.9 |
| 603 | V | A | 36.05 |
| 605 | R | K | 40.9 |
| 607 | Y | H | 41.38 |
| 609 | D | E | 45.95 |
| 610 | K | T | 45.84 |
| 613 | S | N | 51.09 |
| 617 | K | N | 56.75 |
| 624 | T | A | 64.88 |
| 626 | S | M | 60.97 |
| 627 | V | I | 57.43 |
| 637 | K | N | 42.63 |
| 641 | E | D | 38.71 |
| 642 | I | V | 36.92 |
| 647 | S | N | 29.22 |
| 648 | E | Q | 30.75 |
| 653 | F | L | 26.85 |
| 660 | V | L | 26.27 |
| 663 | M | I | 26.27 |
| 664 | M | L | 26.99 |

TABLE 1-continued

| aa pos. | HUM | RAT | distance to aa of reference (Å) |
|---|---|---|---|
| 670 | F | Y | 28.76 |
| 683 | D | G | 49.46 |
| 690 | V | I | 40.04 |
| 716 | E | N | 60.95 |
| 717 | S | N | 62.54 |
| 721 | P | T | 64.1 |
| 726 | G | R | 58.11 |
| 733 | Y | S | 49.53 |
| 734 | V | I | 46.73 |
| 747 | S | R | 35.94 |
| 750 | A | D | 38.19 |

TABLE 2

| aa pos. | HUM | MU | distance to aa of reference (Å) |
|---|---|---|---|
| 57 | F | Y | 30.42 |
| 64 | G | E | 46.67 |
| 72 | A | E | 30.96 |
| 74 | N | D | 35.61 |
| 78 | L | F | 42.46 |
| 84 | G | R | 42.58 |
| 85 | Q | E | 43.72 |
| 88 | T | I | 43.24 |
| 93 | R | S | 43.31 |
| 101 | S | T | 38.96 |
| 102 | N | D | 40.41 |
| 136 | S | Q | 55.96 |
| 144 | N | Y | 61.64 |
| 185 | F | Y | 64.38 |
| 186 | N | T | 63.68 |
| 191 | K | R | 57.71 |
| 217 | N | D | 58.09 |
| 224 | A | V | 56.62 |
| 229 | T | S | 60.5 |
| 233 | V | I | 54.23 |
| 242 | E | G | 49.32 |
| 264 | I | V | 59.95 |
| 267 | I | V | 63.87 |
| 273 | A | H | 70.89 |
| 274 | Y | H | 72.78 |
| 278 | Q | M | 66.9 |
| 284 | A | E | 67.3 |
| 300 | T | S | 59 |
| 301 | D | S | 60.96 |
| 328 | Q | H | 72.16 |
| 329 | T | A | 69.98 |
| 331 | D | E | 68.26 |
| 335 | T | N | 67.63 |
| 339 | I | V | 59.27 |
| 356 | V | A | 50.4 |
| 359 | Y | Q | 56.3 |
| 362 | I | T | 60.49 |
| 399 | N | Y | 41.15 |
| 417 | E | G | 35.94 |
| 431 | S | N | 56.56 |
| 432 | Y | S | 57.15 |
| 457 | D | Y | 47.06 |
| 458 | Y | K | 48.96 |
| 471 | I | L | 19.07 |
| 486 | K | Q | 33.08 |
| 487 | I | V | 29.68 |
| 497 | A | S | 11.55 |
| 499 | K | R | 7.95 |
| 506 | E | V | 18.65 |
| 512 | E | K | 37.64 |
| 513 | V | D | 39.8 |
| 514 | D | G | 43.57 |
| 515 | E | G | 44.32 |
| 516 | I | L | 41.48 |
| 518 | L | F | 34.87 |
| 550 | R | K | 27.19 |
| 559 | S | T | 15.7 |

TABLE 2-continued

| aa pos. | HUM | MU | distance to aa of reference (Å) |
|---|---|---|---|
| 567 | M | I | 19.02 |
| 584 | L | F | 42.67 |
| 586 | Y | H | 46.36 |
| 601 | I | L | 36.05 |
| 616 | K | E | 31.12 |
| 659 | V | I | 49.32 |

TABLE 2-continued

| aa pos. | HUM | MU | distance to aa of reference (Å) |
|---|---|---|---|
| 661 | T | S | 47.68 |
| 736 | L | I | 32.18 |
| 739 | L | R | 28.95 |
| 741 | T | Q | 27.16 |

| SEQ ID NO. | DESIGNATION | SOURCE | TYPE | SEQUENCE |
|---|---|---|---|---|
| 1. | Human CD3ε extracellular domain | human | aa | QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD |
| 2. | Human CD3ε 1-27 | human | aa | QDGNEEMGGITQTPYKVSISGTTVILT |
| 3. | Callithrix jacchus CD3ε extracellular domain | Callithrix jacchus | aa | QDGNEEMGDTTQNPYKVSISGTTVTLTCPRYDGHEIKWLVNSQNKEGHEDHLLLEDFSEMEQSGYYACLSKETPAEEASHYLYLKARVCENCVEVD |
| 4. | Callithrix jacchus CD3ε 1-27 | Callithrix jacchus | aa | QDGNEEMGDTTQNPYKVSISGTTVTLT |
| 5. | Saguinus oedipus CD3ε extracellular domain | Saguinus oedipus | aa | QDGNEEMGDTTQNPYKVSISGTTVTLTCPRYDGHEIKWLVNSQNKEGHEDHLLLEDFSEMEQSGYYACLSKETPAEEASHYLYLKARVCENCVEVD |
| 6. | Saguinus oedipus CD3ε 1-27 | Saguinus oedipus | aa | QDGNEEMGDTTQNPYKVSISGTTVTLT |
| 7. | Saimiri sciureus CD3ε extracellular domain | Saimiri sciureus | aa | QDGNEEIGDTTQNPYKVSISGTTVTLTCPRYDGQEIKWLVNDQNKEGHEDHLLLEDFSEMEQSGYYACLSKETPTEEASHYLYLKARVCENCVEVD |
| 8. | Saimiri sciureus CD3ε 1-27 | Saimiri sciureus | aa | QDGNEEIGDTTQNPYKVSISGTTVTLT |
| 9. | CDR-L1 of F6A | artificial | aa | GSSTGAVTSGYYPN |
| 10. | CDR-L2 of F6A | artificial | aa | GTKFLAP |
| 11. | CDR-L3 of F6A | artificial | aa | ALWYSNRWV |
| 12. | CDR-H1 of F6A | artificial | aa | IYAMN |
| 13. | CDR-H2 of F6A | artificial | aa | RIRSKYNNYATYYADSVKS |
| 14. | CDR-H3 of F6A | artificial | aa | HGNFGNSYVSFFAY |
| 15. | VH of F6A | artificial | aa | EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS |
| 16. | VH of F6A | artificial | nt | GAGGTGCAGCTGGTCGAGTCTGGAGGAGGATTGGTGCAGCCTGGAGGGTCATTGAAACTCTCATGTGCAGCCTCTGGATTCACCTTCAATATCTACGCCATGAACTGGGTCCGCCAGGCTCAGGAAAGGGTTTGGAATGGGTTGCTCGCATAAGAAGTAAATATAATAATTATGCAACATATTATGCCGATTCAGTGAAAGCCAGGTTCACCATCTCCAGAGATGATTCAAAAAACACTGCCTATCTACAAATGAACAACTTGAAAACTGAGGACACTGCCGTGTACTACTGTGTGAGACATGGGAACTTCGGTAATAGCTACGTATCCTTCTTCGCTTACTGGGGCCAAGGGACTCTGGTCACCGTCTCCTCA |
| 17. | VL of F6A | artificial | aa | QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL |

| SEQ ID NO. | DESIGNATION | SOURCE | TYPE | SEQUENCE |
|---|---|---|---|---|
| 18. | VL of F6A | artificial | nt | CAGACTGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGGACTAAGTTCCTCGCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 19. | VH-P of F6A | artificial | aa | EVQLLESGGGLVQPGGSLKLSCAASGFTFNIYAMNWVRQAPGKGLEWVARIRSKYNNYATYYADS VKSRFTISRDDSKNTAYLQMNNLKTEDTAVYYCVRHGNFGNSYVSFFAYWGQGTLVTVSS |
| 20. | VH-P of F6A | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATATCTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAAGCAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACG TATCCTTCTTCGCTTACTGGGGCCAAGGGACTCTGGTCACCGTCTCCTCA |
| 21. | VL-P of F6A | artificial | aa | ELVVTQEPSLTVSPGGTVTLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 22. | VL-P of F6A | artificial | nt | GAGCTCGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGGACTAAGTTCCTCGCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 23. | VH-VL of F6A | artificial | aa | EVQLVESGGGLVQPGGSLKLSCAASGFTFNIYAMNWVRQAPGKGLEWVARIRSKYNNYATYYADS VKSRFTISRDDSKNTAYLQMNNLKTEDTAVYYCVRHGNFGNSYVSFFAYWGQGTLVTVSSGGGGS GGGGSGGGGSQTVVTQEPSLTVSPGGTVTLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 24. | VH-VL of F6A | artificial | nt | GAGGTGCAGCTGGTCGAGTCTGGAGGAGGATTGGTGCAGCCTGGAGGGTCATTGAAACTCTCATG TGCAGCCTCTGGATTCACCTTCAATATCTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAAGCAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACG TATCCTTCTTCGCTTACTGGGGCCAAGGGACTCTGGTCACCGTCTCCTCAGGTGGTGGTGGTTCT GGCGGCGGCGGCTCCGGTGGTGGTGGTTCTCAGACTGTTGTGACTCAGGAACCTTCACTCACCGT ATCACCTGGTGGAACAGTCACACTCACTTGTGGCTCCTCGACTGGGGCTGTTACATCTGGCTACT ACCCAAACTGGGTCCAACAAAAACCAGGTCAGGCACCCCGTGGTCTAATAGGTGGGACTAAGTTC CTCGCCCCGGTACTCCTGCCAGATTCTCAGGCTCCCTGCTTGGAGGCAAGGCTGCCCTCACCCT CTCAGGGGTACAGCCAGAGGATGAGGCAGAATATTACTGTGCTCTATGGTACAGCAACCGCTGGG TGTTCGGTGGAGGAACCAAACTGACTGTCCTA |
| 25. | VH-VL-P of F6A | artificial | aa | EVQLLESGGGLVQPGGSLKLSCAASGFTFNIYAMNWVRQAPGKGLEWVARIRSKYNNYATYYADS VKSRFTISRDDSKNTAYLQMNNLKTEDTAVYYCVRHGNFGNSYVSFFAYWGQGTLVTVSSGGGGS GGGGSGGGGSELVVTQEPSLTVSPGGTVTLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 26. | VH-VL-P of F6A | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATATCTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAAGCAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACG TATCCTTCTTCGCTTACTGGGGCCAAGGGACTCTGGTCACCGTCTCCTCAGGTGGTGGTGGTTCT GGCGGCGGCGGCTCCGGTGGTGGTGGTTCTGAGCTCGTTGTGACTCAGGAACCTTCACTCACCGT ATCACCTGGTGGAACAGTCACACTCACTTGTGGCTCCTCGACTGGGGCTGTTACATCTGGCTACT ACCCAAACTGGGTCCAACAAAAACCAGGTCAGGCACCCCGTGGTCTAATAGGTGGGACTAAGTTC CTCGCCCCGGTACTCCTGCCAGATTCTCAGGCTCCCTGCTTGGAGGCAAGGCTGCCCTCACCCT CTCAGGGGTACAGCCAGAGGATGAGGCAGAATATTACTGTGCTCTATGGTACAGCAACCGCTGGG TGTTCGGTGGAGGAACCAAACTGACTGTCCTA |
| 27. | CDR-L1 of H2C | artificial | aa | GSSTGAVTSGYYPN |
| 28. | CDR-L2 of H2C | artificial | aa | GTKFLAP |
| 29. | CDR-L3 of H2C | artificial | aa | ALWYSNRWV |
| 30. | CDR-H1 of H2C | artificial | aa | KYAMN |
| 31. | CDR-H2 of H2C | artificial | aa | RIRSKYNNYATYYADSVKD |
| 32. | CDR-H3 of H2C | artificial | aa | HGNFGNSYISYWAY |

-continued

| SEQ ID NO. | DESIGNATION | SOURCE | TYPE | SEQUENCE |
|---|---|---|---|---|
| 33. | VH of H2C | artificial | aa | EVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSS |
| 34. | VH of H2C | artificial | nt | GAGGTGCAGCTGGTCGAGTCTGGAGGAGGATTGGTGCAGCCTGGAGGGTCATTGAAACTCTCATG TGCAGCCTCTGGATTCACCTTCAATAAGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGACAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACA TATCCTACTGGGCTTACTGGGGCCAAGGGACTCTGGTCACCGTCTCCTCA |
| 35. | VL of H2C | artificial | aa | QTVVTQEPSLTVSPGGTVTLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 36. | VL of H2C | artificial | nt | CAGACTGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGGACTAAGTTCCTCGCCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 37. | VH-P of H2C | artificial | aa | EVQLLESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSS |
| 38. | VH-P of H2C | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATAAGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGACAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACA TATCCTACTGGGCTTACTGGGGCCAAGGGACTCTGGTCACCGTCTCCTCA |
| 39. | VL-P of H2C | artificial | aa | ELVVTQEPSLTVSPGGTVTLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 40. | VL-P of H2C | artificial | nt | GAGCTCGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGGACTAAGTTCCTCGCCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 41. | VH-VL of H2C | artificial | aa | EVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGS GGGGSGGGGSQTVVTQEPSLTVSPGGTVTLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 42. | VH-VL of H2C | artificial | nt | GAGGTGCAGCTGGTCGAGTCTGGAGGAGGATTGGTGCAGCCTGGAGGGTCATTGAAACTCTCATG TGCAGCCTCTGGATTCACCTTCAATAAGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGACAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACA TATCCTACTGGGCTTACTGGGGCCAAGGGACTCTGGTCACCGTCTCCTCAGGTGGTGGTGGTTCT GGCGGCGGCGGCTCCGGTGGTGGTGGTTCTCAGACTGTTGTGACTCAGGAACCTTCACTCACCGT ATCACCTGGTGGAACAGTCACACTCACTTGTGGCTCCTCGACTGGGGCTGTTACATCTGGCTACT ACCCAAACTGGGTCCAACAAAAACCAGGTCAGGCACCCCGTGGTCTAATAGGTGGGACTAAGTTC CTCGCCCCCGGTACTCCTGCCAGATTCTCAGGCTCCCTGCTTGGAGGCAAGGCTGCCCTCACCCT CTCAGGGGTACAGCCAGAGGATGAGGCAGAATATTACTGTGCTCTATGGTACAGCAACCGCTGGG TGTTCGGTGGAGGAACCAAACTGACTGTCCTA |
| 43. | VH-VL-P of H2C | artificial | aa | EVQLLESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGS GGGGSGGGGSELVVTQEPSLTVSPGGTVTLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 44. | VH-VL-P of H2C | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATAAGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGACAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACA TATCCTACTGGGCTTACTGGGGCCAAGGGACTCTGGTCACCGTCTCCTCAGGTGGTGGTGGTTCT GGCGGCGGCGGCTCCGGTGGTGGTGGTTCTGAGCTCGTTGTGACTCAGGAACCTTCACTCACCGT ATCACCTGGTGGAACAGTCACACTCACTTGTGGCTCCTCGACTGGGGCTGTTACATCTGGCTACT ACCCAAACTGGGTCCAACAAAAACCAGGTCAGGCACCCCGTGGTCTAATAGGTGGGACTAAGTTC CTCGCCCCCGGTACTCCTGCCAGATTCTCAGGCTCCCTGCTTGGAGGCAAGGCTGCCCTCACCCT CTCAGGGGTACAGCCAGAGGATGAGGCAGAATATTACTGTGCTCTATGGTACAGCAACCGCTGGG TGTTCGGTGGAGGAACCAAACTGACTGTCCTA |

| SEQ ID NO. | DESIGNATION | SOURCE | TYPE | SEQUENCE |
|---|---|---|---|---|
| 45. | CDR-L1 of H1E | artificial | aa | GSSTGAVTSGYYPN |
| 46. | CDR-L2 of H1E | artificial | aa | GTKFLAP |
| 47. | CDR-L3 of H1E | artificial | aa | ALWYSNRWV |
| 48. | CDR-H1 of H1E | artificial | aa | SYAMN |
| 49. | CDR-H2 of H1E | artificial | aa | RIRSKYNNYATYYADSVKG |
| 50. | CDR-H3 of H1E | artificial | aa | HGNFGNSYLSFWAY |
| 51. | VH of H1E | artificial | aa | EVQLVESGGGLEQPGGSLKLSCAASGFTFNSYAMNWVRQAPGKGLEWVARIRSKYNNYATYYADS VKGRFTISRDDSKNTAYLQMNNLKTEDTAVYYCVRHGNFGNSYLSFWAYWGQGTLVTVSS |
| 52. | VH of H1E | artificial | nt | GAGGTGCAGCTGGTCGAGTCTGGAGGAGGATTGGAGCAGCCTGGAGGGTCATTGAAACTCTCATG TGCAGCCTCTGGATTCACCTTCAATTCGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGGGAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACC TATCCTTCTGGGCTTACTGGGGCCAAGGGACTCTGGTCACCGTCTCCTC |
| 53. | VL of H1E | artificial | aa | QTVVTQEPSLTVSPGGTVTLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 54. | VL of H1E | artificial | nt | CAGACTGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGGACTAAGTTCCTCGCCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 55. | VH-P of H1E | artificial | aa | EVQLLESGGGLEQPGGSLKLSCAASGFTFNSYAMNWVRQAPGKGLEWVARIRSKYNNYATYYADS VKGRFTISRDDSKNTAYLQMNNLKTEDTAVYYCVRHGNFGNSYLSFWAYWGQGTLVTVSS |
| 56. | VH-P of H1E | artificial | nt | GAGGTGCAGCTGCTCGAGTCTGGAGGAGGATTGGAGCAGCCTGGAGGGTCATTGAAACTCTCATG TGCAGCCTCTGGATTCACCTTCAATTCGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGGGAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACC TATCCTTCTGGGCTTACTGGGGCCAAGGGACTCTGGTCACCGTCTCCTCA |
| 57. | VL-P of H1E | artificial | aa | ELVVTQEPSLTVSPGGTVTLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 58. | VL-P of H1E | artificial | nt | GAGCTCGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGGACTAAGTTCCTCGCCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 59. | VH-VL of H1E | artificial | aa | EVQLVESGGGLEQPGGSLKLSCAASGFTFNSYAMNWVRQAPGKGLEWVARIRSKYNNYATYYADS VKGRFTISRDDSKNTAYLQMNNLKTEDTAVYYCVRHGNFGNSYLSFWAYWGQGTLVTVSSGGGGS GGGGSGGGGSQTVVTQEPSLTVSPGGTVTLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 60. | VH-VL of H1E | artificial | nt | GAGGTGCAGCTGGTCGAGTCTGGAGGAGGATTGGAGCAGCCTGGAGGGTCATTGAAACTCTCATG TGCAGCCTCTGGATTCACCTTCAATTCGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGGGAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACC TATCCTTCTGGGCTTACTGGGGCCAAGGGACTCTGGTCACCGTCTCCTCAGGTGGTGGTGGTTCT GGCGGCGGCGGCTCCGGTGGTGGTGGTTCTCAGACTGTTGTGACTCAGGAACCTTCACTCACCGT ATCACCTGGTGGAACAGTCACACTCACTTGTGGCTCCTCGACTGGGGCTGTTACATCTGGCTACT ACCCAAACTGGGTCCAACAAAAACCAGGTCAGGCACCCCGTGGTCTAATAGGTGGGACTAAGTTC CTCGCCCCCGGTACTCCTGCCAGATTCTCAGGCTCCCTGCTTGGAGGCAAGGCTGCCCTCACCCT CTCAGGGGTACAGCCAGAGGATGAGGCAGAATATTACTGTGCTCTATGGTACAGCAACCGCTGGG TGTTCGGTGGAGGAACCAAACTGACTGTCCTA |
| 61. | VH-VL-P of H1E | artificial | aa | EVQLLESGGGLEQPGGSLKLSCAASGFTFNSYAMNWVRQAPGKGLEWVARIRSKYNNYATYYADS VKGRFTISRDDSKNTAYLQMNNLKTEDTAVYYCVRHGNFGNSYLSFWAYWGQGTLVTVSSGGGGS GGGGSGGGGSELVVTQEPSLTVSPGGTVTLTCGSSTGAVTSGYYPNWVQQKPGQAPRGLIGGTKF LAPGTPARFSGSLLGGKAALTLSGVQPEDEAEYYCALWYSNRWVFGGGTKLTVL |

| SEQ ID NO. | DESIGNATION | SOURCE | TYPE | SEQUENCE |
|---|---|---|---|---|
| 62. | VH-VL-P of H1E | artificial | nt | GAGGTGCAGCTGCTCGAGTCTGGAGGAGGATTGGAGCAGCCTGGAGGGTCATTGAAACTCTCATG TGCAGCCTCTGGATTCACCTTCAATTCGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGGGAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACC TATCCTTCTGGGCTTACTGGGGCAAGGGACTCTGGTCACCGTCTCCTCAGGTGGTGGTGGTTCT GGCGGCGGCGGCTCCGGTGGTGGTGGTTCTGAGCTCGTTGTGACTCAGGAACCTTCACTCACCGT ATCACCTGGTGGAACAGTCACACTCACTTGTGGCTCCTCGACTGGGGCTGTTACATCTGGCTACT ACCCAAACTGGGTCCAACAAAAACCAGGTCAGGCACCCCGTGGTCTAATAGGTGGGACTAAGTTC CTCGCCCCCGGTACTCCTGCCAGATTCTCAGGCTCCCTGCTTGGAGGCAAGGCTGCCCTCACCCT CTCAGGGGTACAGCCAGAGGATGAGGCAGAATATTACTGTGCTCTATGGTACAGCAACCGCTGGG TGTTCGGTGGAGGAACCAAACTGACTGTCCTA |
| 63. | CDR-L1 of G4H | artificial | aa | GSSTGAVTSGYYPN |
| 64. | CDR-L2 of G4H | artificial | aa | GTKFLAP |
| 65. | CDR-L3 of G4H | artificial | aa | ALWYSNRWV |
| 66. | CDR-H1 of G4H | artificial | aa | RYAMN |
| 67. | CDR-H2 of G4H | artificial | aa | RIRSKYNNYATYYADSVKG |
| 68. | CDR-H3 of G4H | artificial | aa | HGNFGNSYLSYFAY |
| 69. | VH of G4H | artificial | aa | EVQLVESGGGLVQPGGSLKLSCAASGFTFNRYAMNWVRQAPGKGLEWVARIRSKYNNYATYYADS VKGRFTISRDDSKNTAYLQMNNLKTEDTAVYYCVRHGNFGNSYLSYFAYWGQGTLVTVSS |
| 70. | VH of G4H | artificial | nt | GAGGTGCAGCTGGTCGAGTCTGGAGGAGGATTGGTGCAGCCTGGAGGGTCATTGAAACTCTCATG TGCAGCCTCTGGATTCACCTTCAATCGCTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGGGAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACT TATCCTACTTCGCTTACTGGGGCCAAGGGACTCTGGTCACCGTCTCCTCA |
| 71. | VL of G4H | artificial | aa | QTVVTQEPSLTVSPGGTVTLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 72. | VL of G4H | artificial | nt | CAGACTGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGGACTAAGTTCCTCGCCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 73. | VH-P of G4H | artificial | aa | EVQLLESGGGLVQPGGSLKLSCAASGFTFNRYAMNWVRQAPGKGLEWVARIRSKYNNYATYYADS VKGRFTISRDDSKNTAYLQMNNLKTEDTAVYYCVRHGNFGNSYLSYFAYWGQGTLVTVSS |
| 74. | VH-P of G4H | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATCGCTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGGGAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACT TATCCTACTTCGCTTACTGGGGCCAAGGGACTCTGGTCACCGTCTCCTCA |
| 75. | VL-P of G4H | artificial | aa | ELVVTQEPSLTVSPGGTVTLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 76. | VL-P of G4H | artificial | nt | GAGCTCGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGGACTAAGTTCCTCGCCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 77. | VH-VL of G4H | artificial | aa | EVQLVESGGGLVQPGGSLKLSCAASGFTFNRYAMNWVRQAPGKGLEWVARIRSKYNNYATYYADS VKGRFTISRDDSKNTAYLQMNNLKTEDTAVYYCVRHGNFGNSYLSYFAYWGQGTLVTVSSGGGGS GGGGSGGGGSQTVVTQEPSLTVSPGGTVTLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 78. | VH-VL of G4H | artificial | nt | GAGGTGCAGCTGGTCGAGTCTGGAGGAGGATTGGTGCAGCCTGGAGGGTCATTGAAACTCTCATG TGCAGCCTCTGGATTCACCTTCAATCGCTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGGGAGGTTCACCATCTCCAGAGATGATTCAAAAAACACTGCCTATCTACAAATGAACAA |

| SEQ ID NO. | DESIGNATION | SOURCE | TYPE | SEQUENCE |
|---|---|---|---|---|
| | | | | CTTGAAAACTGAGGACACTGCCGTGTACTACTGTGTGAGACATGGGAACTTCGGTAATAGCTACT<br>TATCCTACTTCGCTTACTGGGGCCAAGGGACTCTGGTCACCGTCTCCTCAGGTGGTGGTGGTTCT<br>GGCGGCGGCGGCTCCGGTGGTGGTGGTTCTCAGACTGTTGTGACTCAGGAACCTTCACTCACCGT<br>ATCACCTGGTGGAACAGTCACACTCACTTGTGGCTCCTCGACTGGGGCTGTTACATCTGGCTACT<br>ACCCAAACTGGGTCCAACAAAAACCAGGTCAGGCACCCCGTGGTCTAATAGGTGGGACTAAGTTC<br>CTCGCCCCCGGTACTCCTGCCAGATTCTCAGGCTCCCTGCTTGGAGGCAAGGCTGCCCTCACCCT<br>CTCAGGGGTACAGCCAGAGGATGAGGCAGAATATTACTGTGCTCTATGGTACAGCAACCGCTGGG<br>TGTTCGGTGGAGGAACCAAACTGACTGTCCTA |
| 79. | VH-VL-P of G4H | artificial | aa | EVQLLESGGGLVQPGGSLKLSCAASGFTFNRYAMNWVRQAPGKGLEWVARIRSKYNNYATYYADS<br>VKGRFTISRDDSKNTAYLQMNNLKTEDTAVYYCVRHGNFGNSYLSYFAYWGQGTLVTVSSGGGGS<br>GGGGSGGGGSELVVTQEPSLTVSPGGTVTLTCGSSTGAVTSGYYPNWVQQKPGQAPRGLIGGTKF<br>LAPGTPARFSGSLLGGKAALTLSGVQPEDEAEYYCALWYSNRWVFGGGTKLTVL |
| 80. | VH-VL-P of G4H | artificial | nt | GAGGTGCAGCTGCTCGAGTCTGGAGGAGGATTGGTGCAGCCTGGAGGGTCATTGAAACTCTCATG<br>TGCAGCCTCTGGATTCACCTTCAATCGCTACGCCATGAACTGGGTCCGCCAGGCTCCAGGAAGG<br>GTTTGGAATGGGTTGCTCGCATAAGAAGTAAATATAATAATTATGCAACATATTATGCCGATTCA<br>GTGAAAGGGAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACT<br>TATCCTACTTCGCTTACTGGGGCCAAGGGACTCTGGTCACCGTCTCCTCAGGTGGTGGTGGTTCT<br>GGCGGCGGCGGCTCCGGTGGTGGTGGTTCTGAGCTCGTTGTGACTCAGGAACCTTCACTCACCGT<br>ATCACCTGGTGGAACAGTCACACTCACTTGTGGCTCCTCGACTGGGGCTGTTACATCTGGCTACT<br>ACCCAAACTGGGTCCAACAAAAACCAGGTCAGGCACCCCGTGGTCTAATAGGTGGGACTAAGTTC<br>CTCGCCCCCGGTACTCCTGCCAGATTCTCAGGCTCCCTGCTTGGAGGCAAGGCTGCCCTCACCCT<br>CTCAGGGGTACAGCCAGAGGATGAGGCAGAATATTACTGTGCTCTATGGTACAGCAACCGCTGGG<br>TGTTCGGTGGAGGAACCAAACTGACTGTCCTA |
| 81. | CDR-L1 of A2J | artificial | aa | RSSTGAVTSGYYPN |
| 82. | CDR-L2 of A2J | artificial | aa | ATDMRPS |
| 83. | CDR-L3 of A2J | artificial | aa | ALWYSNRWV |
| 84. | CDR-H1 of A2J | artificial | aa | VYAMN |
| 85. | CDR-H2 of A2J | artificial | aa | RIRSKYNNYATYYADSVKK |
| 86. | CDR-H3 of A2J | artificial | aa | HGNFGNSYLSWWAY |
| 87. | VH of A2J | artificial | aa | EVQLVESGGGLVQPGGSLKLSCAASGFTFNVYAMNWVRQAPGKGLEWVARIRSKYNNYATYYADS<br>VKKRFTISRDDSKNTAYLQMNNLKTEDTAVYYCVRHGNFGNSYLSWWAYWGQGTLVTVSS |
| 88. | VH of A2J | artificial | nt | GAGGTGCAGCTGGTCGAGTCTGGAGGAGGATTGGTGCAGCCTGGAGGGTCATTGAAACTCTCATG<br>TGCAGCCTCTGGATTCACCTTCAATGTCTACGCCATGAACTGGGTCCGCCAGGCTCCAGGAAGG<br>GTTTGGAATGGGTTGCTCGCATAAGAAGTAAATATAATAATTATGCAACATATTATGCCGATTCA<br>GTGAAAAAGAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACT<br>TATCCTGGTGGGCTTACTGGGGCCAAGGGACTCTGGTCACCGTCTCCTCA |
| 89. | VL of A2J | artificial | aa | QTVVTQEPSLTVSPGGTVTLTCRSSTGAVTSGYYPNWVQQKPGQAPRGLIGATDMRPSGTPARFS<br>GSLLGGKAALTLSGVQPEDEAEYYCALWYSNRWVFGGGTKLTVL |
| 90. | VL of A2J | artificial | nt | CAGACTGTTGTGACTCAGGAACCTTCACTCACCGTATCACCTGGTGGAACAGTCACACTCACTTG<br>TCGCTCCTCGACTGGGGCTGTTACATCTGGCTACTACCCAAACTGGGTCCAACAAAAACCAGGTC<br>AGGCACCCCGTGGTCTAATAGGTGCCACTGACATGAGGCCCTCTGGTACTCCTGCCAGATTCTCA<br>GGCTCCCTGCTTGGAGGCAAGGCTGCCCTCACCCTCTCAGGGGTACAGCCAGAGGATGAGGCAGA<br>ATATTACTGTGCTCTATGGTACAGCAACCGCTGGGTGTTCGGTGGAGGAACCAAACTGACTGTCC<br>TA |
| 91. | VH-P of A2J | artificial | aa | EVQLLESGGGLVQPGGSLKLSCAASGFTFNVYAMNWVRQAPGKGLEWVARIRSKYNNYATYYADS<br>VKKRFTISRDDSKNTAYLQMNNLKTEDTAVYYCVRHGNFGNSYLSWWAYWGQGTLVTVSS |
| 92. | VH-P of A2J | artificial | nt | GAGGTGCAGCTGCTCGAGTCTGGAGGAGGATTGGTGCAGCCTGGAGGGTCATTGAAACTCTCATG<br>TGCAGCCTCTGGATTCACCTTCAATGTCTACGCCATGAACTGGGTCCGCCAGGCTCCAGGAAGG<br>GTTTGGAATGGGTTGCTCGCATAAGAAGTAAATATAATAATTATGCAACATATTATGCCGATTCA<br>GTGAAAAAGAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACT<br>TATCCTGGTGGGCTTACTGGGGCCAAGGGACTCTGGTCACCGTCTCCTCA |
| 93. | VL-P of A2J | artificial | aa | ELVVTQEPSLTVSPGGTVTLTCRSSTGAVTSGYYPNWVQQKPGQAPRGLIGATDMRPSGTPARFS<br>GSLLGGKAALTLSGVQPEDEAEYYCALWYSNRWVFGGGTKLTVL |
| 94. | VL-P of A2J | artificial | nt | GAGCTCGTTGTGACTCAGGAACCTTCACTCACCGTATCACCTGGTGGAACAGTCACACTCACTTG<br>TCGCTCCTCGACTGGGGCTGTTACATCTGGCTACTACCCAAACTGGGTCCAACAAAAACCAGGTC<br>AGGCACCCCGTGGTCTAATAGGTGCCACTGACATGAGGCCCTCTGGTACTCCTGCCAGATTCTCA |

| SEQ ID NO. | DESIGNATION | SOURCE | TYPE | SEQUENCE |
|---|---|---|---|---|
| | | | | GGCTCCCTGCTTGGAGGCAAGGCTGCCCTCACCCTCTCAGGGGTACAGCCAGAGGATGAGGCAGA<br>ATATTACTGTGCTCTATGGTACAGCAACCGCTGGGTGTTCGGTGGAGGAACCAAACTGACTGTCC<br>TA |
| 95. | VH-VL of A2J | artificial | aa | EVQLVESGGGLVQPGGSLKLSCAASGFTFNVYAMNWVRQAPGKGLEWVARIRSKYNNYATYYADS<br>VKKRFTISRDDSKNTAYLQMNNLKTEDTAVYYCVRHGNFGNSYLSWWAYWGQGTLVTVSSGGGGS<br>GGGGSGGGGSQTVVTQEPSLTVSPGGTVTLTCRSSTGAVTSGYYPNWVQQKPGQAPRGLIGATDM<br>RPSGTPARFSGSLLGGKAALTLSGVQPEDEAEYYCALWYSNRWVFGGGTKLTVL |
| 96. | VH-VL of A2J | artificial | nt | GAGGTGCAGCTGGTCGAGTCTGGAGGAGGATTGGTGCAGCCTGGAGGGTCATTGAAACTCTCATG<br>TGCAGCCTCTGGATTCACCTTCAATGTCTACGCCATGAACTGGGTCCGCCAGGCTCCAGGAAAGG<br>GTTTGGAATGGGTTGCTCGCATAAGAAGTAAATATAATAATTATGCAACATATTATGCCGATTCA<br>GTGAAAAAGAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACT<br>TATCCTGGTGGGCTTACTGGGGCCAAGGGACTCTGGTCACCGTCTCCTCAGGTGGTGGTGGTTCT<br>GGCGGCGGCGGCTCCGGTGGTGGTGGTTCTCAGACTGTTGTGACTCAGGAACCTTCACTCACCGT<br>ATCACCTGGTGGAACAGTCACACTCACTTGTCGCTCCTCGACTGGGGCTGTTACATCTGGCTACT<br>ACCCAAACTGGGTCCAACAAAAACCAGGTCAGGCACCCCGTGGTCTAATAGGTGCCACTGACATG<br>AGGCCCTCTGGTACTCCTGCCAGATTCTCAGGCTCCCTGCTTGGAGGCAAGGCTGCCCTCACCCT<br>CTCAGGGGTACAGCCAGAGGATGAGGCAGAATATTACTGTGCTCTATGGTACAGCAACCGCTGGG<br>TGTTCGGTGGAGGAACCAAACTGACTGTCCTA |
| 97. | VH-VL-P of A2J | artificial | aa | EVQLLESGGGLVQPGGSLKLSCAASGFTFNVYAMNWVRQAPGKGLEWVARIRSKYNNYATYYADS<br>VKKRFTISRDDSKNTAYLQMNNLKTEDTAVYYCVRHGNFGNSYLSWWAYWGQGTLVTVSSGGGGS<br>GGGGSGGGGSELVVTQEPSLTVSPGGTVTLTCRSSTGAVTSGYYPNWVQQKPGQAPRGLIGATDM<br>RPSGTPARFSGSLLGGKAALTLSGVQPEDEAEYYCALWYSNRWVFGGGTKLTVL |
| 98. | VH-VL-P of A2J | artificial | nt | GAGGTGCAGCTGCTCGAGTCTGGAGGAGGATTGGTGCAGCCTGGAGGGTCATTGAAACTCTCATG<br>TGCAGCCTCTGGATTCACCTTCAATGTCTACGCCATGAACTGGGTCCGCCAGGCTCCAGGAAAGG<br>GTTTGGAATGGGTTGCTCGCATAAGAAGTAAATATAATAATTATGCAACATATTATGCCGATTCA<br>GTGAAAAAGAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACT<br>TATCCTGGTGGGCTTACTGGGGCCAAGGGACTCTGGTCACCGTCTCCTCAGGTGGTGGTGGTTCT<br>GGCGGCGGCGGCTCCGGTGGTGGTGGTTCTGAGCTCGTTGTGACTCAGGAACCTTCACTCACCGT<br>ATCACCTGGTGGAACAGTCACACTCACTTGTCGCTCCTCGACTGGGGCTGTTACATCTGGCTACT<br>ACCCAAACTGGGTCCAACAAAAACCAGGTCAGGCACCCCGTGGTCTAATAGGTGCCACTGACATG<br>AGGCCCTCTGGTACTCCTGCCAGATTCTCAGGCTCCCTGCTTGGAGGCAAGGCTGCCCTCACCCT<br>CTCAGGGGTACAGCCAGAGGATGAGGCAGAATATTACTGTGCTCTATGGTACAGCAACCGCTGGG<br>TGTTCGGTGGAGGAACCAAACTGACTGTCCTA |
| 99. | CDR-L1 of E1L | artificial | aa | GSSTGAVTSGYYPN |
| 100. | CDR-L2 of E1L | artificial | aa | GTKFLAP |
| 101. | CDR-L3 of E1L | artificial | aa | ALWYSNRWV |
| 102. | CDR-H1 of E1L | artificial | aa | KYAMN |
| 103. | CDR-H2 of E1L | artificial | aa | RIRSKYNNYATYYADSVKS |
| 104. | CDR-H3 of E1L | artificial | aa | HGNFGNSYTSYYAY |
| 105. | VH of E1L | artificial | aa | EVQLVESGGGLVQPGGSLKLSCAASGFTFNKYAMNWVRQAPGKGLEWVARIRSKYNNYATYYADS<br>VKSRFTISRDDSKNTAYLQMNNLKTEDTAVYYCVRHGNFGNSYTSYYAYWGQGTLVTVSS |
| 106. | VH of E1L | artificial | nt | GAGGTGCAGCTGGTCGAGTCTGGAGGAGGATTGGTGCAGCCTGGAGGGTCATTGAAACTCTCATG<br>TGCAGCCTCTGGATTCACCTTCAATAAGTACGCCATGAACTGGGTCCGCCAGGCTCCAGGAAAGG<br>GTTTGGAATGGGTTGCTCGCATAAGAAGTAAATATAATAATTATGCAACATATTATGCCGATTCA<br>GTGAAATCGAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACA<br>CATCCTACTACGCTTACTGGGGCCAAGGGACTCTGGTCACCGTCTCCTCA |
| 107. | VL of E1L | artificial | aa | QTVVTQEPSLTVSPGGTVTLTCGSSTGAVTSGYYPNWVQQKPGQAPRGLIGGTKFLAPGTPARFS<br>GSLLGGKAALTLSGVQPEDEAEYYCALWYSNRWVFGGGTKLTVL |
| 108. | VL of E1L | artificial | nt | CAGACTGTTGTGACTCAGGAACCTTCACTCACCGTATCACCTGGTGGAACAGTCACACTCACTTG<br>TGGCTCCTCGACTGGGGCTGTTACATCTGGCTACTACCCAAACTGGGTCCAACAAAAACCAGGTC<br>AGGCACCCCGTGGTCTAATAGGTGGGACTAAGTTCCTCGCCCCCGGTACTCCTGCCAGATTCTCA<br>GGCTCCCTGCTTGGAGGCAAGGCTGCCCTCACCCTCTCAGGGGTACAGCCAGAGGATGAGGCAGA<br>ATATTACTGTGCTCTATGGTACAGCAACCGCTGGGTGTTCGGTGGAGGAACCAAACTGACTGTCC<br>TA |
| 109. | VH-P of E1L | artificial | aa | EVQLLESGGGLVQPGGSLKLSCAASGFTFNKYAMNWVRQAPGKGLEWVARIRSKYNNYATYYADS<br>VKSRFTISRDDSKNTAYLQMNNLKTEDTAVYYCVRHGNFGNSYTSYYAYWGQGTLVTVSS |

| SEQ ID NO. | DESIGNATION | SOURCE | TYPE | SEQUENCE |
|---|---|---|---|---|
| 110. | VH-P of E1L | artificial | nt | GAGGTGCAGCTGCTCGAGTCTGGAGGAGGATTGGTGCAGCCTGGAGGGTCATTGAAACTCTCATG<br>TGCAGCCTCTGGATTCACCTTCAATAAGTACGCCATGAACTGGGTCCGCCAGGCTCCAGGAAAGG<br>GTTTGGAATGGGTTGCTCGCATAAGAAGTAAATATAATAATTATGCAACATATTATGCCGATTCA<br>GTGAAATCGAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACA<br>CATCCTACTACGCTTACTGGGGCCAAGGGACTCTGGTCACCGTCTCCTCA |
| 111. | VL-P of E1L | artificial | aa | ELVVTQEPSLTVSPGGTVTLTCGSSTGAVTSGYYPNWVQQKPGQAPRGLIGGTKFLAPGTPARFS<br>GSLLGGKAALTLSGVQPEDEAEYYCALWYSNRWVFGGGTKLTVL |
| 112. | VL-P of E1L | artificial | nt | GAGCTCGTTGTGACTCAGGAACCTTCACTCACCGTATCACCTGGTGGAACAGTCACACTCACTTG<br>TGGCTCCTCGACTGGGGCTGTTACATCTGGCTACTACCCAAACTGGGTCCAACAAAAACCAGGTC<br>AGGCACCCCGTGGTCTAATAGGTGGGACTAAGTTCCTCGCCCCCGGTACTCCTGCCAGATTCTCA<br>GGCTCCCTGCTTGGAGGCAAGGCTGCCCTCACCCTCTCAGGGGTACAGCCAGAGGATGAGGCAGA<br>ATATTACTGTGCTCTATGGTACAGCAACCGCTGGGTGTTCGGTGGAGGAACCAAACTGACTGTCC<br>TA |
| 113. | VH-VL of E1L | artificial | aa | EVQLVESGGGLVQPGGSLKLSCAASGFTFNKYAMNWVRQAPGKGLEWVARIRSKYNNYATYYADS<br>VKSRFTISRDDSKNTAYLQMNNLKTEDTAVYYCVRHGNFGNSYTSYYAYWGQGTLVTVSSGGGGS<br>GGGGSGGGGSQTVVTQEPSLTVSPGGTVTLTCGSSTGAVTSGYYPNWVQQKPGQAPRGLIGGTKF<br>LAPGTPARFSGSLLGGKAALTLSGVQPEDEAEYYCALWYSNRWVFGGGTKLTVL |
| 114. | VH-VL of E1L | artificial | nt | GAGGTGCAGCTGGTCGAGTCTGGAGGAGGATTGGTGCAGCCTGGAGGGTCATTGAAACTCTCATG<br>TGCAGCCTCTGGATTCACCTTCAATAAGTACGCCATGAACTGGGTCCGCCAGGCTCCAGGAAAGG<br>GTTTGGAATGGGTTGCTCGCATAAGAAGTAAATATAATAATTATGCAACATATTATGCCGATTCA<br>GTGAAATCGAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACA<br>CATCCTACTACGCTTACTGGGGCCAAGGGACTCTGGTCACCGTCTCCTCAGGTGGTGGTGGTTCT<br>GGCGGCGGCGGCTCCGGTGGTGGTGGTTCTCAGACTGTTGTGACTCAGGAACCTTCACTCACCGT<br>ATCACCTGGTGGAACAGTCACACTCACTTGTGGCTCCTCGACTGGGGCTGTTACATCTGGCTACT<br>ACCCAAACTGGGTCCAACAAAAACCAGGTCAGGCACCCCGTGGTCTAATAGGTGGGACTAAGTTC<br>CTCGCCCCCGGTACTCCTGCCAGATTCTCAGGCTCCCTGCTTGGAGGCAAGGCTGCCCTCACCCT<br>CTCAGGGGTACAGCCAGAGGATGAGGCAGAATATTACTGTGCTCTATGGTACAGCAACCGCTGGG<br>TGTTCGGTGGAGGAACCAAACTGACTGTCCTA |
| 115. | VH-VL-P of E1L | artificial | aa | EVQLLESGGGLVQPGGSLKLSCAASGFTFNKYAMNWVRQAPGKGLEWVARIRSKYNNYATYYADS<br>VKSRFTISRDDSKNTAYLQMNNLKTEDTAVYYCVRHGNFGNSYTSYYAYWGQGTLVTVSSGGGGS<br>GGGGSGGGGSELVVTQEPSLTVSPGGTVTLTCGSSTGAVTSGYYPNWVQQKPGQAPRGLIGGTKF<br>LAPGTPARFSGSLLGGKAALTLSGVQPEDEAEYYCALWYSNRWVFGGGTKLTVL |
| 116. | VH-VL-P of E1L | artificial | nt | GAGGTGCAGCTGCTCGAGTCTGGAGGAGGATTGGTGCAGCCTGGAGGGTCATTGAAACTCTCATG<br>TGCAGCCTCTGGATTCACCTTCAATAAGTACGCCATGAACTGGGTCCGCCAGGCTCCAGGAAAGG<br>GTTTGGAATGGGTTGCTCGCATAAGAAGTAAATATAATAATTATGCAACATATTATGCCGATTCA<br>GTGAAATCGAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACA<br>CATCCTACTACGCTTACTGGGGCCAAGGGACTCTGGTCACCGTCTCCTCAGGTGGTGGTGGTTCT<br>GGCGGCGGCGGCTCCGGTGGTGGTGGTTCTGAGCTCGTTGTGACTCAGGAACCTTCACTCACCGT<br>ATCACCTGGTGGAACAGTCACACTCACTTGTGGCTCCTCGACTGGGGCTGTTACATCTGGCTACT<br>ACCCAAACTGGGTCCAACAAAAACCAGGTCAGGCACCCCGTGGTCTAATAGGTGGGACTAAGTTC<br>CTCGCCCCCGGTACTCCTGCCAGATTCTCAGGCTCCCTGCTTGGAGGCAAGGCTGCCCTCACCCT<br>CTCAGGGGTACAGCCAGAGGATGAGGCAGAATATTACTGTGCTCTATGGTACAGCAACCGCTGGG<br>TGTTCGGTGGAGGAACCAAACTGACTGTCCTA |
| 117. | CDR-L1 of E2M | artificial | aa | RSSTGAVTSGYYPN |
| 118. | CDR-L2 of E2M | artificial | aa | ATDMRPS |
| 119. | CDR-L3 of E2M | artificial | aa | ALWYSNRWV |
| 120. | CDR-H1 of E2M | artificial | aa | GYAMN |
| 121. | CDR-H2 of E2M | artificial | aa | RIRSKYNNYATYYADSVKE |
| 122. | CDR-H3 of E2M | artificial | aa | HRNFGNSYLSWFAY |
| 123. | VH of E2M | artificial | aa | EVQLVESGGGLVQPGGSLKLSCAASGFTFNGYAMNWVRQAPGKGLEWVARIRSKYNNYATYYADS<br>VKERFTISRDDSKNTAYLQMNNLKTEDTAVYYCVRHRNFGNSYLSWFAYWGQGTLVTVSS |
| 124. | VH of E2M | artificial | nt | GAGGTGCAGCTGGTCGAGTCTGGAGGAGGATTGGTGCAGCCTGGAGGGTCATTGAAACTCTCATG<br>TGCAGCCTCTGGATTCACCTTCAATGGCTACGCCATGAACTGGGTCCGCCAGGCTCCAGGAAAGG<br>GTTTGGAATGGGTTGCTCGCATAAGAAGTAAATATAATAATTATGCAACATATTATGCCGATTCA<br>GTGAAAGAGAGGTTCACCATCTCCAGAGATGATTCAAAAAACACTGCCTATCTACAAATGAACAA<br>CTTGAAAACTGAGGACACTGCCGTGTACTACTGTGTGAGACATAGGAACTTCGGTAATAGCTACT<br>TATCCTGGTTCGCTTACTGGGGCCAAGGGACTCTGGTCACCGTCTCCTCA |

-continued

| SEQ ID NO. | DESIGNATION | SOURCE | TYPE | SEQUENCE |
|---|---|---|---|---|
| 125. | VL of E2M | artificial | aa | QTVVTQEPSLTVSPGGTVTLTCRSSTGAVTSGYYPNWVQQKPGQAPRGLIGATDMRPSGTPARFS GSLLGGKAALTLSGVQPEDEAEYYCALWYSNRWVFGGGTKLTVL |
| 126. | VL of E2M | artificial | nt | CAGACTGTTGTGACTCAGGAACCTTCACTCACCGTATCACCTGGTGGAACAGTCACACTCACTTG TCGCTCCTCGACTGGGGCTGTTACATCTGGCTACTACCCAAACTGGGTCCAACAAAAACCAGGTC AGGCACCCCGTGGTCTAATAGGTGCCACTGACATGAGGCCCTCTGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 127. | VH-P of E2M | artificial | aa | EVQLLESGGGLVQPGGSLKLSCAASGFTFNGYAMNWVRQAPGKGLEWVARIRSKYNNYATYYADS VKERFTISRDDSKNTAYLQMNNLKTEDTAVYYCVRHRNFGNSYLSWFAYWGQGTLVTVSS |
| 128. | VH-P of E2M | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATGGCTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGAGAGGTTCACCATCTCCAGAGATGATTCAAAAAACACTGCCTATCTACAAATGAACAA CTTGAAAACTGAGGACACTGCCGTGTACTACTGTGTGAGACATAGGAACTTCGGTAATAGCTACT TATCCTGGTTCGCTTACTGGGGCCAAGGGACTCTGGTCACCGTCTCCTCA |
| 129. | VL-P of E2M | artificial | aa | ELVVTQEPSLTVSPGGTVTLTCRSSTGAVTSGYYPNWVQQKPGQAPRGLIGATDMRPSGTPARFS GSLLGGKAALTLSGVQPEDEAEYYCALWYSNRWVFGGGTKLTVL |
| 130. | VL-P of E2M | artificial | nt | GAGCTCGTTGTGACTCAGGAACCTTCACTCACCGTATCACCTGGTGGAACAGTCACACTCACTTG TCGCTCCTCGACTGGGGCTGTTACATCTGGCTACTACCCAAACTGGGTCCAACAAAAACCAGGTC AGGCACCCCGTGGTCTAATAGGTGCCACTGACATGAGGCCCTCTGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 131. | VH-VL of E2M | artificial | aa | EVQLVESGGGLVQPGGSLKLSCAASGFTFNGYAMNWVRQAPGKGLEWVARIRSKYNNYATYYADS VKERFTISRDDSKNTAYLQMNNLKTEDTAVYYCVRHRNFGNSYLSWFAYWGQGTLVTVSSGGGGS GGGGSGGGGSQTVVTQEPSLTVSPGGTVTLTCRSSTGAVTSGYYPNWVQQKPGQAPRGLIGATDM RPSGTPARFSGSLLGGKAALTLSGVQPEDEAEYYCALWYSNRWVFGGGTKLTVL |
| 132. | VH-VL of E2M | artificial | nt | GAGGTGCAGCTGGTCGAGTCTGGAGGAGGATTGGTGCAGCCTGGAGGGTCATTGAAACTCTCATG TGCAGCCTCTGGATTCACCTTCAATGGCTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGAGAGGTTCACCATCTCCAGAGATGATTCAAAAAACACTGCCTATCTACAAATGAACAA CTTGAAAACTGAGGACACTGCCGTGTACTACTGTGTGAGACATAGGAACTTCGGTAATAGCTACT TATCCTGGTTCGCTTACTGGGGCCAAGGGACTCTGGTCACCGTCTCCTCAGGTGGTGGTGGTTCT GGCGGCGGCGGCTCCGGTGGTGGTGGTTCTCAGACTGTTGTGACTCAGGAACCTTCACTCACCGT ATCACCTGGTGGAACAGTCACACTCACTTGTCGCTCCTCGACTGGGGCTGTTACATCTGGCTACT ACCCAAACTGGGTCCAACAAAAACCAGGTCAGGCACCCCGTGGTCTAATAGGTGCCACTGACATG AGGCCCTCTGGTACTCCTGCCAGATTCTCAGGCTCCCTGCTTGGAGGCAAGGCTGCCCTCACCCT CTCAGGGGTACAGCCAGAGGATGAGGCAGAATATTACTGTGCTCTATGGTACAGCAACCGCTGGG TGTTCGGTGGAGGAACCAAACTGACTGTCCTA |
| 133. | VH-VL-P of E2M | artificial | aa | EVQLLESGGGLVQPGGSLKLSCAASGFTFNGYAMNWVRQAPGKGLEWVARIRSKYNNYATYYADS VKERFTISRDDSKNTAYLQMNNLKTEDTAVYYCVRHRNFGNSYLSWFAYWGQGTLVTVSSGGGGS GGGGSGGGGSELVVTQEPSLTVSPGGTVTLTCRSSTGAVTSGYYPNWVQQKPGQAPRGLIGATDM RPSGTPARFSGSLLGGKAALTLSGVQPEDEAEYYCALWYSNRWVFGGGTKLTVL |
| 134. | VH-VL-P of E2M | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATGGCTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGAGAGGTTCACCATCTCCAGAGATGATTCAAAAAACACTGCCTATCTACAAATGAACAA CTTGAAAACTGAGGACACTGCCGTGTACTACTGTGTGAGACATAGGAACTTCGGTAATAGCTACT TATCCTGGTTCGCTTACTGGGGCCAAGGGACTCTGGTCACCGTCTCCTCAGGTGGTGGTGGTTCT GGCGGCGGCGGCTCCGGTGGTGGTGGTTCTGAGCTCGTTGTGACTCAGGAACCTTCACTCACCGT ATCACCTGGTGGAACAGTCACACTCACTTGTCGCTCCTCGACTGGGGCTGTTACATCTGGCTACT ACCCAAACTGGGTCCAACAAAAACCAGGTCAGGCACCCCGTGGTCTAATAGGTGCCACTGACATG AGGCCCTCTGGTACTCCTGCCAGATTCTCAGGCTCCCTGCTTGGAGGCAAGGCTGCCCTCACCCT CTCAGGGGTACAGCCAGAGGATGAGGCAGAATATTACTGTGCTCTATGGTACAGCAACCGCTGGG TGTTCGGTGGAGGAACCAAACTGACTGTCCTA |
| 135. | CDR-L1 of F7O | artificial | aa | GSSTGAVTSGYYPN |
| 136. | CDR-L2 of F7O | artificial | aa | GTKFLAP |
| 137. | CDR-L3 of F7O | artificial | aa | ALWYSNRWV |
| 138. | CDR-H1 of F7O | artificial | aa | VYAMN |
| 139. | CDR-H2 of F7O | artificial | aa | RIRSKYNNYATYYADSVKK |

| SEQ ID NO. | DESIGNATION | SOURCE | TYPE | SEQUENCE |
|---|---|---|---|---|
| 140. | CDR-H3 of F70 | artificial | aa | HGNFGNSYISWWAY |
| 141. | VH of F70 | artificial | aa | EVQLVESGGGLVQPGGSLKLSCAASGFTFNVYAMNWVRQAPGKGLEWVARIRSKYNNYATYYADS VKKRFTISRDDSKNTAYLQMNNLKTEDTAVYYCVRHGNFGNSYISWWAYWGQGTLVTVSS |
| 142. | VH of F70 | artificial | nt | GAGGTGCAGCTGGTCGAGTCTGGAGGAGGATTGGTGCAGCCTGGAGGGTCATTGAAACTCTCATG TGCAGCCTCTGGATTCACCTTCAATGTGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAAAGAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACA TATCCTGGTGGGCTTACTGGGGCCAAGGGACTCTGGTCACCGTCTCCTCA |
| 143. | VL of F70 | artificial | aa | QTVVTQEPSLTVSPGGTVTLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 144. | VL of F70 | artificial | nt | CAGACTGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGGACTAAGTTCCTCGCCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 145. | VH-P of F70 | artificial | aa | EVQLLESGGGLVQPGGSLKLSCAASGFTFNVYAMNWVRQAPGKGLEWVARIRSKYNNYATYYADS VKKRFTISRDDSKNTAYLQMNNLKTEDTAVYYCVRHGNFGNSYISWWAYWGQGTLVTVSS |
| 146. | VH-P of F70 | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATGTGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAAAGAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACA TATCCTGGTGGGCTTACTGGGGCCAAGGGACTCTGGTCACCGTCTCCTCA |
| 147. | VL-P of F70 | artificial | aa | ELVVTQEPSLTVSPGGTVTLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 148. | VL-P of F70 | artificial | nt | GAGCTCGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGGACTAAGTTCCTCGCCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGGAACCAAACTGACTGTCC TA |
| 149. | VH-VL of F70 | artificial | aa | EVQLVESGGGLVQPGGSLKLSCAASGFTFNVYAMNWVRQAPGKGLEWVARIRSKYNNYATYYADS VKKRFTISRDDSKNTAYLQMNNLKTEDTAVYYCVRHGNFGNSYISWWAYWGQGTLVTVSSGGGGS GGGGSGGGGSQTVVTQEPSLTVSPGGTVTLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 150. | VH-VL of F70 | artificial | nt | GAGGTGCAGCTGGTCGAGTCTGGAGGAGGATTGGTGCAGCCTGGAGGGTCATTGAAACTCTCATG TGCAGCCTCTGGATTCACCTTCAATGTGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAAAGAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACA TATCCTGGTGGGCTTACTGGGGCCAAGGGACTCTGGTCACCGTCTCCTCAGGTGGTGGTGGTTCT GGCGGCGGCGGCTCCGGTGGTGGTGGTTCTCAGACTGTTGTGACTCAGGAACCTTCACTCACCGT ATCACCTGGTGGAACAGTCACACTCACTTGTGGCTCCTCGACTGGGGCTGTTACATCTGGCTACT ACCCAAACTGGGTCCAACAAAAACCAGGTCAGGCACCCCGTGGTCTAATAGGTGGGACTAAGTTC CTCGCCCCCGGTACTCCTGCCAGATTCTCAGGCTCCCTGCTTGGAGGCAAGGCTGCCCTCACCCT CTCAGGGGTACAGCCAGAGGATGAGGCAGAATATTACTGTGCTCTATGGTACAGCAACCGCTGGG TGTTCGGTGGAGGAACCAAACTGACTGTCCTA |
| 151. | VH-VL-P of F70 | artificial | aa | EVQLLESGGGLVQPGGSLKLSCAASGFTFNVYAMNWVRQAPGKGLEWVARIRSKYNNYATYYADS VKKRFTISRDDSKNTAYLQMNNLKTEDTAVYYCVRHGNFGNSYISWWAYWGQGTLVTVSSGGGGS GGGGSGGGGSELVVTQEPSLTVSPGGTVTLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 152. | VH-VL-P of F70 | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATGTGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAAAGAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACA TATCCTGGTGGGCTTACTGGGGCCAAGGGACTCTGGTCACCGTCTCCTCAGGTGGTGGTGGTTCT GGCGGCGGCGGCTCCGGTGGTGGTGGTTCTGAGCTCGTTGTGACTCAGGAACCTTCACTCACCGT ATCACCTGGTGGAACAGTCACACTCACTTGTGGCTCCTCGACTGGGCTGTTACATCTGGCTACT ACCCAAACTGGGTCCAACAAAAACCAGGTCAGGCACCCCGTGGTCTAATAGGTGGGACTAAGTTC |

| SEQ ID NO. | DESIGNATION | SOURCE | TYPE | SEQUENCE |
|---|---|---|---|---|
| | | | | CTCGCCCCGGTACTCCTGCCAGATTCTCAGGCTCCCTGCTTGGAGGCAAGGCTGCCCTCACCCT<br>CTCAGGGGTACAGCCAGAGGATGAGGCAGAATATTACTGTGCTCTATGGTACAGCAACCGCTGGG<br>TGTTCGGTGGAGGAACCAAACTGACTGTCCTA |
| 153. | CDR-L1 of F12Q | artificial | aa | GSSTGAVTSGNYPN |
| 154. | CDR-L2 of F12Q | artificial | aa | GTKFLAP |
| 155. | CDR-L3 of F12Q | artificial | aa | VLWYSNRWV |
| 156. | CDR-H1 of F12Q | artificial | aa | SYAMN |
| 157. | CDR-H2 of F12Q | artificial | aa | RIRSKYNNYATYYADSVKG |
| 158. | CDR-H3 of F12Q | artificial | aa | HGNFGNSYVSWWAY |
| 159. | VH of F12Q | artificial | aa | EVQLVESGGGLVQPGGSLKLSCAASGFTFNSYAMNWVRQAPGKGLEWVARIRSKYNNYATYYADS<br>VKGRFTISRDDSKNTAYLQMNNLKTEDTAVYYCVRHGNFGNSYVSWWAYWGQGTLVTVSS |
| 160. | VH of F12Q | artificial | nt | GAGGTGCAGCTGGTCGAGTCTGGAGGAGGATTGGTGCAGCCTGGAGGGTCATTGAAACTCTCATG<br>TGCAGCCTCTGGATTCACCTTCAATAGCTACGCCATGAACTGGGTCCGCCAGGCTCCAGGAAGG<br>GTTTGGAATGGGTTGCTCGCATAAGAAGTAAATATAATAATTATGCAACATATTATGCCGATTCA<br>GTGAAAGGCAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACG<br>TTTCCTGGTGGGCTTACTGGGGCCAAGGGACTCTGGTCACCGTCTCCTCA |
| 161. | VL of F12Q | artificial | aa | QTVVTQEPSLTVSPGGTVTLTCGSSTGAVTSGNYPNWVQQKPGQAPRGLIGGTKFLAPGTPARFS<br>GSLLGGKAALTLSGVQPEDEAEYYCVLWYSNRWVFGGGTKLTVL |
| 162. | VL of F12Q | artificial | nt | CAGACTGTTGTGACTCAGGAACCTTCACTCACCGTATCACCTGGTGGAACAGTCACACTCACTTG<br>TGGCTCCTCGACTGGGGCTGTTACATCTGGCAACTACCCAAACTGGGTCCAACAAAAACCAGGTC<br>AGGCACCCCGTGGTCTAATAGGTGGGACTAAGTTCCTCGCCCCCGGTACTCCTGCCAGATTCTCA<br>GGCTCCCTGCTTGGAGGCAAGGCTGCCCTCACCCTCTCAGGGGTACAGCCAGAGGATGAGGCAGA<br>ATATTACTGTGTTCTATGGTACAGCAACCGCTGGGTGTTCGGTGGAGGAACCAAACTGACTGTCC<br>TA |
| 163. | VH-P of F12Q | artificial | aa | EVQLLESGGGLVQPGGSLKLSCAASGFTFNSYAMNWVRQAPGKGLEWVARIRSKYNNYATYYADS<br>VKGRFTISRDDSKNTAYLQMNNLKTEDTAVYYCVRHGNFGNSYVSWWAYWGQGTLVTVSS |
| 164. | VH-P of F12Q | artificial | nt | GAGGTGCAGCTGCTCGAGTCTGGAGGAGGATTGGTGCAGCCTGGAGGGTCATTGAAACTCTCATG<br>TGCAGCCTCTGGATTCACCTTCAATAGCTACGCCATGAACTGGGTCCGCCAGGCTCCAGGAAGG<br>GTTTGGAATGGGTTGCTCGCATAAGAAGTAAATATAATAATTATGCAACATATTATGCCGATTCA<br>GTGAAAGGCAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACG<br>TTTCCTGGTGGGCTTACTGGGGCCAAGGGACTCTGGTCACCGTCTCCTCA |
| 165. | VL-P of F12Q | artificial | aa | ELVVTQEPSLTVSPGGTVTLTCGSSTGAVTSGNYPNWVQQKPGQAPRGLIGGTKFLAPGTPARFS<br>GSLLGGKAALTLSGVQPEDEAEYYCVLWYSNRWVFGGGTKLTVL |
| 166. | VL-P of F12Q | artificial | nt | GAGCTCGTTGTGACTCAGGAACCTTCACTCACCGTATCACCTGGTGGAACAGTCACACTCACTTG<br>TGGCTCCTCGACTGGGGCTGTTACATCTGGCAACTACCCAAACTGGGTCCAACAAAAACCAGGTC<br>AGGCACCCCGTGGTCTAATAGGTGGGACTAAGTTCCTCGCCCCCGGTACTCCTGCCAGATTCTCA<br>GGCTCCCTGCTTGGAGGCAAGGCTGCCCTCACCCTCTCAGGGGTACAGCCAGAGGATGAGGCAGA<br>ATATTACTGTGTTCTATGGTACAGCAACCGCTGGGTGTTCGGTGGAGGAACCAAACTGACTGTCC<br>TA |
| 167. | VH-VL of F12Q | artificial | aa | EVQLVESGGGLVQPGGSLKLSCAASGFTFNSYAMNWVRQAPGKGLEWVARIRSKYNNYATYYADS<br>VKGRFTISRDDSKNTAYLQMNNLKTEDTAVYYCVRHGNFGNSYVSWWAYWGQGTLVTVSSGGGGS<br>GGGGSGGGGSQTVVTQEPSLTVSPGGTVTLTCGSSTGAVTSGNYPNWVQQKPGQAPRGLIGGTKF<br>LAPGTPARFSGSLLGGKAALTLSGVQPEDEAEYYCVLWYSNRWVFGGGTKLTVL |
| 168. | VH-VL of F12Q | artificial | nt | GAGGTGCAGCTGGTCGAGTCTGGAGGAGGATTGGTGCAGCCTGGAGGGTCATTGAAACTCTCATG<br>TGCAGCCTCTGGATTCACCTTCAATAGCTACGCCATGAACTGGGTCCGCCAGGCTCCAGGAAGG<br>GTTTGGAATGGGTTGCTCGCATAAGAAGTAAATATAATAATTATGCAACATATTATGCCGATTCA<br>GTGAAAGGCAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACG<br>TTTCCTGGTGGGCTTACTGGGGCCAAGGGACTCTGGTCACCGTCTCCTCAGGTGGTGGTGGTTCT<br>GGCGGCGGCGGCTCCGGTGGTGGTGGTTCTCAGACTGTTGTGACTCAGGAACCTTCACTCACCGT<br>ATCACCTGGTGGAACAGTCACACTCACTTGTGGCTCCTCGACTGGGGCTGTTACATCTGGCAACT<br>ACCCAAACTGGGTCCAACAAAAACCAGGTCAGGCACCCCGTGGTCTAATAGGTGGGACTAAGTTC<br>CTCGCCCCCGGTACTCCTGCCAGATTCTCAGGCTCCCTGCTTGGAGGCAAGGCTGCCCTCACCCT<br>CTCAGGGGTACAGCCAGAGGATGAGGCAGAATATTACTGTGTTCTATGGTACAGCAACCGCTGGG<br>TGTTCGGTGGAGGAACCAAACTGACTGTCCTA |

| SEQ ID NO. | DESIGNATION | SOURCE | TYPE | SEQUENCE |
|---|---|---|---|---|
| 169. | VH-VL-P of F12Q | artificial | aa | EVQLLESGGGLVQPGGSLKLSCAASGFTFNSYAMNWVRQAPGKGLEWVARIRSKYNNYATYYADS VKGRFTISRDDSKNTAYLQMNNLKTEDTAVYYCVRHGNFGNSYVSWWAYWGQGTLVTVSSGGGGS GGGGSGGGGSELVVTQEPSLTVSPGGTVTLTCGSSTGAVTSGNYPNWVQQKPGQAPRGLIGGTKF LAPGTPARFSGSLLGGKAALTLSGVQPEDEAEYYCVLWYSNRWVFGGGTKLTVL |
| 170. | VH-VL-P of F12Q | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATAGCTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGGCAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACG TTTCCTGGTGGGCTTACTGGGGCCAAGGGACTCTGGTCACCGTCTCCTCAGGTGGTGGTGGTTCT GGCGGCGGCGGCTCCGGTGGTGGTGGTTCTGAGCTCGTTGTGACTCAGGAACCTTCACTCACCGT ATCACCTGGTGGAACAGTCACACTCACTTGTGGCTCCTCGACTGGGGCTGTTACATCTGGCAACT ACCCAAACTGGGTCCAACAAAAACCAGGTCAGGCACCCCGTGGTCTAATAGGTGGGACTAAGTTC CTCGCCCCCGGTACTCCTGCCAGATTCTCAGGCTCCCTGCTTGGAGGCAAGGCTGCCCTCACCCT CTCAGGGGTACAGCCAGAGGATGAGGCAGAATATTACTGTGTTCTATGGTACAGCAACCGCTGGG TGTTCGGTGGAGGAACCAAACTGACTGTCCTA |
| 171. | CDR-L1 of I2C | artificial | aa | GSSTGAVTSGNYPN |
| 172. | CDR-L2 of I2C | artificial | aa | GTKFLAP |
| 173. | CDR-L3 of I2C | artificial | aa | VLWYSNRWV |
| 174. | CDR-H1 of I2C | artificial | aa | KYAMN |
| 175. | CDR-H2 of I2C | artificial | aa | RIRSKYNNYATYYADSVKD |
| 176. | CDR-H3 of I2C | artificial | aa | HGNFGNSYISYWAY |
| 177. | VH of I2C | artificial | aa | EVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSS |
| 178. | VH of I2C | artificial | nt | GAGGTGCAGCTGGTCGAGTCTGGAGGAGGATTGGTGCAGCCTGGAGGGTCATTGAAACTCTCATG TGCAGCCTCTGGATTCACCTTCAATAAGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGACAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACA TATCCTACTGGGCTTACTGGGGCCAAGGGACTCTGGTCACCGTCTCCTCA |
| 179. | VL of I2C | artificial | aa | QTVVTQEPSLTVSPGGTVTLTCGSSTGAVTSGNYPNWVQQKPGQAPRGLIGGTKFLAPGTPARFS GSLLGGKAALTLSGVQPEDEAEYYCVLWYSNRWVFGGGTKLTVL |
| 180. | VL of I2C | artificial | nt | CAGACTGTTGTGACTCAGGAACCTTCACTCACCGTATCACCTGGTGGAACAGTCACACTCACTTG TGGCTCCTCGACTGGGGCTGTTACATCTGGCAACTACCCAAACTGGGTCCAACAAAAACCAGGTC AGGCACCCCGTGGTCTAATAGGTGGGACTAAGTTCCTCGCCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGTTCTATGGTACAGCAACCGCTGGGTGTTCGGTGGAGGAACCAAACTGACTGTCC TA |
| 181. | VH-P of I2C | artificial | aa | EVQLLESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSS |
| 182. | VH-P of I2C | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATAAGTACGCCATGAACTGGGTCCGCCAGGCTCCAGGAAAGG GTTTGGAATGGGTTGCTCGCATAAGAAGTAAATATAATAATTATGCAACATATTATGCCGATTCA GTGAAAGACAGGTTCACCATCTCCAGAGATGATTCAAAAAACACTGCCTATCTACAAATGAACAA CTTGAAAACTGAGGACACTGCCGTGTACTACTGTGTGAGACATGGGAACTTCGGTAATAGCTACA TATCCTACTGGGCTTACTGGGGCCAAGGGACTCTGGTCACCGTCTCCTCA |
| 183. | VL-P of I2C | artificial | aa | ELVVTQEPSLTVSPGGTVTLTCGSSTGAVTSGNYPNWVQQKPGQAPRGLIGGTKFLAPGTPARFS GSLLGGKAALTLSGVQPEDEAEYYCVLWYSNRWVFGGGTKLTVL |
| 184. | VL-P of I2C | artificial | nt | GAGCTCGTTGTGACTCAGGAACCTTCACTCACCGTATCACCTGGTGGAACAGTCACACTCACTTG TGGCTCCTCGACTGGGGCTGTTACATCTGGCAACTACCCAAACTGGGTCCAACAAAAACCAGGTC AGGCACCCCGTGGTCTAATAGGTGGGACTAAGTTCCTCGCCCCCGGTACTCCTGCCAGATTCTCA GGCTCCCTGCTTGGAGGCAAGGCTGCCCTCACCCTCTCAGGGGTACAGCCAGAGGATGAGGCAGA ATATTACTGTGTTCTATGGTACAGCAACCGCTGGGTGTTCGGTGGAGGAACCAAACTGACTGTCC TA |
| 185. | VH-VL of I2C | artificial | aa | EVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGS GGGGSGGGGSQTVVTQEPSLTVSPGGTVTLTCGSSTGAVTSGNYPNWVQQKPGQAPRGLIGGTKF LAPGTPARFSGSLLGGKAALTLSGVQPEDEAEYYCVLWYSNRWVFGGGTKLTVL |

-continued

| SEQ ID NO. | DESIGNATION | SOURCE | TYPE | SEQUENCE |
|---|---|---|---|---|
| 186. | VH-VL of I2C | artificial | nt | GAGGTGCAGCTGGTCGAGTCTGGAGGAGGATTGGTGCAGCCTGGAGGGTCATTGAAACTCTCATG<br>TGCAGCCTCTGGATTCACCTTCAATAAGTACGCCATGAACTGGGTCCGCCAGGCTCCAGGAAAGG<br>GTTTGGAATGGGTTGCTCGCATAAGAAGTAAATATAATAATTATGCAACATATTATGCCGATTCA<br>GTGAAAGACAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACA<br>TATCCTACTGGGCTTACTGGGGCAAGGGACTCTGGTCACCGTCTCCTCAGGTGGTGGTGGTTCT<br>GGCGGCGGCGGCTCCGGTGGTGGTGGTTCTGGCGGCGGCGGCTCCGGTGGTGGTGGTTCTCAGACTGTTGTGACTCAGGAACCTTCACTCACCGT<br>ATCACCTGGTGGAACAGTCACACTCACTTGTGGCTCCTCGACTGGGGCTGTTACATCTGGCAACT<br>ACCCAAACTGGGTCCAACAAAAACCAGGTCAGGCACCCCGTGGTCTAATAGGTGGGACTAAGTTC<br>CTCGCCCCCGGTACTCCTGCCAGATTCTCAGGCTCCCTGCTTGGAGGCAAGGCTGCCCTCACCCT<br>CTCAGGGGTACAGCCAGAGGATGAGGCAGAATATTACTGTGTTCTATGGTACAGCAACCGCTGGG<br>TGTTCGGTGGAGGAACCAAACTGACTGTCCTA |
| 187. | VH-VL-P of I2C | artificial | aa | EVQLLESGGGLVQPGGSLKLSCAASGFTFNKYAMNWVRQAPGKGLEWVARIRSKYNNYATYYADS<br>VKDRFTISRDDSKNTAYLQMNNLKTEDTAVYYCVRHGNFGNSYISYWAYWGQGTLVTVSSGGGGS<br>GGGGSGGGGSELVVTQEPSLTVSPGGTVTLTCGSSTGAVTSGNYPNWVQQKPGQAPRGLIGGTKF<br>LAPGTPARFSGSLLGGKAALTLSGVQPEDEAEYYCVLWYSNRWVFGGGTKLTVL |
| 188. | VH-VL-P of I2C | artificial | nt | GAGGTGCAGCTGCTCGAGTCTGGAGGAGGATTGGTGCAGCCTGGAGGGTCATTGAAACTCTCATG<br>TGCAGCCTCTGGATTCACCTTCAATAAGTACGCCATGAACTGGGTCCGCCAGGCTCCAGGAAAGG<br>GTTTGGAATGGGTTGCTCGCATAAGAAGTAAATATAATAATTATGCAACATATTATGCCGATTCA<br>GTGAAAGACAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACA<br>TATCCTACTGGGCTTACTGGGGCAAGGGACTCTGGTCACCGTCTCCTCAGGTGGTGGTGGTTCT<br>GGCGGCGGCGGCTCCGGTGGTGGTGGTTCTGAGCTCGTTGTGACTCAGGAACCTTCACTCACCGT<br>ATCACCTGGTGGAACAGTCACACTCACTTGTGGCTCCTCGACTGGGGCTGTTACATCTGGCAACT<br>ACCCAAACTGGGTCCAACAAAAACCAGGTCAGGCACCCCGTGGTCTAATAGGTGGGACTAAGTTC<br>CTCGCCCCCGGTACTCCTGCCAGATTCTCAGGCTCCCTGCTTGGAGGCAAGGCTGCCCTCACCCT<br>CTCAGGGGTACAGCCAGAGGATGAGGCAGAATATTACTGTGTTCTATGGTACAGCAACCGCTGGG<br>TGTTCGGTGGAGGAACCAAACTGACTGTCCTA |
| 189. | EpCAM-D1-hNG2 | artificial | nt | ATGGGATGGAGCTGTATCATCCTCTTCTTGGTAGCAACAGCTACAGGTGTACACTCCACGGCGAC<br>TTTTGCCGCAGCTCAGGAAGAATGTGTCTGTGAAAACTACAAGCTGGCCGTAAACTGCTTTGTGA<br>ATAATAATCGTCAATGCCAGTGTACTTCAGTTGGTGCACAAAATACTGTCATTTGCTCAAAGCTG<br>GCTGCCAAATGTTTGGTGATGAAGGCAGAAATGAATGGCTCAAAACTTGGGAGAAGAGCAAAACC<br>TGAAGGGGCCCTCCAGAACAATGATGGGCTTTATGATCCTGACTGCGATGAGAGCGGGCTCTTTA<br>AGGCCAAGCAGTGCAACGGCACCTCCACGTGCTGGTGTGTGAACACTGCTGGGGTCAGAAGAACA<br>GACAAGGCACTGAAATAACCTGCTCTGAGCGAGTGAGAACCTACTGGATCATCATTGAACTAAA<br>ACACAAAGCAAGAGAAAAACCTTATGATAGTAAAAGTTTGCGGACTGCACTTCAGAAGGAGATCA<br>CAACGCGTTATCAACTGGATCCAAAATTTATCACGAGTATTTTGTATGAGAATAATGTTATCACT<br>ATTGATCTGGTTCAAAATTCTTCTCAAAAAACTCAGAATGATGTGGACATAGCTGATGTGGCTTA<br>TTATTTTGAAAAAGATGTTAAAGGTGAATCCTTGTTTCATTCTAAGAAAATGGACCTGACAGTAA<br>ATGGGGAACAACTGGATCTGGATCCTGGTCAAACTTTAATTTATTATGTTGATGAAAAAGCACCT<br>GAATTTTCAATGCAGGGTCTAAAAGGCGTACACTCCGACTACAAAGACGATGACGACAAGTCCGT<br>ACACTCCGCTTCCTTCTTCGGTGAGAACCACCTGGAGGTGCCTGTGGCCACGGCTCTGACCGACA<br>TAGACCTGCAGCTGCAGTTCTCCACGTCCCAGCCCGAAGCCCTTCCTTCTCCTGGCAGCAGGCCCA<br>GCTGACCACCTCCTGCTGCAGCTCTACTCTGGACGCCTGCAGGTCAGACTTGTTCTGGGCAGGA<br>GGAGCTGAGGCTGCAGACTCCAGCAGAGACGCTGCTGAGTGACTCCATCCCCCACACTGTGGTGC<br>TGACTGTCGTAGAGGGCTGGGCCACGTTGTCAGTCGATGGGTTTCTGAACGCCTCCTCAGCAGTC<br>CCAGGAGCCCCCCTAGAGGTCCCCTATGGGCTCTTTGTTGGGGGCACTGGGACCCTTGGCCTGCC<br>CTACCTGAGGGGAACCAGCCGACCCCTGAGGGGTTGCCTCCATGCAGCCACCCTCAATGGCCGCA<br>GCCTCCTCCGGCCTCTGACCCCCGATGTGCATGAGGGCTGTGCTGAAGAGTTTTCTGCCAGTGAT<br>GATGTGGCCCTGGGCTTCTCTGGGCCCCACTCTCTGGCTGCCTTCCCTGCCTGGGGCACTCAGGA<br>CGAAGGAACCCTCGAGTTTACACTCACCACCACACAGAGCCGGCAGGCACCCTTGGCCTTCCAGGCAG<br>GGGGCCGGCGTGGGGACTTCATCTATGTGGACATATTTGAGGGCACCTGCGGGCCGTGGTGGAG<br>AAGGGCCAGGGTACCGTATTGCTCCACAACAGTGTGCCTGTGGCCGATGGGCAGCCCCATGAGGT<br>CAGTGTCCACATCAATGCTCACCGGCTGGAAATCTCCGTGGACCAGTACCCTACGCATACTTCGA<br>ACCGAGGAGTCCTCAGCTACCTGGAGCCACGGGGCAGTCTCCTTCTCGGGGGCTGGATGCAGAG<br>GCCTCTCGTCACCTCCAGGAACACCGCCTGGGCCTGACACCAGAGGCCACCAATGCCTCCCTGCT<br>GGGCTGCATGGAAGACCTCAGTGTCAATGGCCAGAGGCGGGGCTGCGGGAAGCTTTGCTGACGC<br>GCAACATGGCAGCCGGCTGCAGGCTGGAGGAGGAGGAGTATGAGGACGATGCCTATGGCCATTAT<br>GAAGCTTTCTCCACCCTGGCTCCCGAGGCTTGGCCAGCCATGGAGCTGCCTGAGCCATGCGTGCC<br>TGAGCCAGGGCTGCCTCCTGTCTTGCCAATTTCACCCAGCTGCTGACTATCAGCCACTAGTGG<br>TGGCCGAGGGTGGCACAGCCTGGCTTGAGTGGAGGCATGTGCAGCCCACGCTGGACCTGATGGAG<br>GCTGAGCTGCGCAAATCCCAGGTGCTGTTCAGCGTGACCCGAGGGGCACACTATGGCGAGCTCGA<br>GCTGGACATCCTGGGTGCCCAGGCACGAAAAATGTTCACCCTCCTGGACGTGGTGAACGCAAGG<br>CCCGCTTCATCCACGATGGCTCTGAGGACACCTCCGACCAGCTGGTGCTGGAGGTGTCGGTGACG<br>GCTCGGGTGCCCATGCCCTCATGCCTTCGGAGGGGCCAAACATACCTCCTGCCCATCCAGGTCAA<br>CCCTGTCAATGACCCACCCCACATCATCTTCCCACATGGCAGCCTCATGGTGATCCTGGAACACA<br>CGCAGAAGCCGCTGGGGCCTGAGGTTTTCCAGGCCTATGACCCGGACTCTGCCTGTGAGGGCCTC<br>ACCTTCCAGGTCCTTGGCACCTCCTCTGGCCTCCCCGTGGAGCGCCGAGACCAGCTGGGGAGCC<br>GGCGACCGAGTTCTCCTGCCGGGAGTTGGAGGCCGGCAGCCAGTCTATGTCCACTGCGGTGGTC<br>CTGCACAGGACTTGACGTTCCGGGTCAGCGATGGACTGCAGGCCAGCCCCCGGCCACGCTGAAG<br>GTGGTGGCCATCCGGCCGGCCATACAGATCCACAGATCTCAATTGTTTCTAGAGGCCAACATGTT |

| SEQ ID NO. | DESIGNATION | SOURCE | TYPE | SEQUENCE |
|---|---|---|---|---|
| | | | | CAGCGTCATCATCCCCATGTGCCTGGTACTTCTGCTCCTGGCGCTCATCCTGCCCCTGCTCTTCT
ACCTCCGAAAACGCAACAAGACGGGCAAGCATGACGTCCAGGTCCTGACTGCCAAGCCCCGCAAC
GGCCTGGCTGGTGACACCGAGACCTTTCGCAAGGTGGAGCCAGGCCAGGCCATCCCGCTCACAGC
TGTGCCTGGCCAGGGGCCCCCTCCAGGAGGCCAGCCTGACCCAGAGCTGCTGCAGTTCTGCCGGA
CACCCAACCCTGCCCTTAAGAATGGCCAGTACTGGGTGTGA |
| 190. | EpCAM-D1-hNG2 | artificial | aa | MGWSCIILFLVATATGVHSTATFAAAQEECVCENYKLAVNCFVNNNRQCQCTSVGAQNTVICSKL
AAKCLVMKAEMNGSKLGRRAKPEGALQNNDGLYDPDCDESGLFKAKQCNGTSTCWCVNTAGVRRT
DKDTEITCSERVRTYWIIIELKHKAREKPYDSKSLRTALQKEITTRYQLDPKFITSILYENNVIT
IDLVQNSSQKTQNDVDIADVAYYFEKDVKGESLFHSKKMDLTVNGEQLDLDPGQTLIYYVDEKAP
EFSMQGLKGVHSDYKDDDDKSVHSASFFGENHLEVPVATALTDIDLQLQFSTSQPEALLLLAAGP
ADHLLLQLYSGRLQVRLVLGQEELRLQTPAETLLSDSIPHTVVLTVVEGWATLSVDGFLNASSAV
PGAPLEVPYGLFVGGTGTLGLPYLRGTSRPLRGCLHAATLNGRSLLRPLTPDVHEGCAEEFSASD
DVALGFSGPHSLAAFPAWGTQDEGTLEFTLTTQSRQAPLAFQAGGRRGDFIYVDIFEGHLRAVVE
KGQGTVLLHNSVPVADGQPHEVSVHINAHRLEISVDQYPTHTSNRGVLSYLEPRGSLLLGGLDAE
ASRHLQEHRLGLTPEATNASLLGCMEDLSVNGQRRGLREALLTRNMAAGCRLEEEEYEDDAYGHY
EAFSTLAPEAWPAMELPEPCVPEPGLPPVFANFTQLLTISPLVVAEGGTAWLEWRHVQPTLDLME
AELRKSQVLFSVTRGAHYGELELDILGAQARKMFTLLDVVNRKARFIHDGSEDTSDQLVLEVSVT
ARVPMPSCLRRGQTYLLPIQVNPVNDPPHIIFPHGSLMVILEHTQKPLGPEVFQAYDPDSACEGL
TFQVLGTSSGLPVERRDQPGEPATEFSCRELEAGSLVYVHCGGPAQDLTFRVSDGLQASPPATLK
VVAIRPAIQIHRSQLFLEANMFSVIIPMCLVLLLLALILPLLFYLRKRNKTGKHDVQVLTAKPRN
GLAGDTETFRKVEPGQAIPLTAVPGQGPPPGGQPDPELLQFCRTPNPALKNGQYWV |
| 191. | EpCAM-D3-hNG2 | artificial | nt | ATGGGATGGAGCTGTATCATCCTCTTCTTGGTAGCAACAGCTACAGGTGTACACTCCACGGCGAC
TTTTGCCGCAGCTCAGGAAGAATGTGTCTGTGAAAACTACAAGCTGGCCGTAAACTGCTTTGTGA
ATAATAATCGTCAATGCCAGTGTACTTCAGTTGGTGCACAAAATACTGTCATTTGCTCAAAGCTG
GCTGCCAAATGTTTGGTGATGAAGGCAGAAATGAATGGCTCAAAACTTGGGAGAAGAGCAAAACC
TGAAGGGGCCCTCCAGAACAATGATGGGCTTTATGATCCTGACTGCGATGAGAGCGGGCTCTTTA
AGGCCAAGCAGTGCAACGGCACCTCCACGTGCTGGTGTGTGAACACTGCTGGGGTCAGAAGAACA
GACAAGGACACTGAAATAACCTGCTCTGAGCGAGTGAGAACCTACTGGATCATCATTGAACTAAA
ACACAAAGCAAGAGAAAAACCTTATGATAGTAAAAGTTTGCGGACTGCACTTCAGAAGGAGATCA
CAACGCGTTATCAACTGGATCCAAAATTTATCACGAGTATTTTGTATGAGAATAATGTTATCACT
ATTGATCTGGTTCAAAATTCTTCTCAAAAAACTCAGAATGATGTGGACATAGCTGATGTGGCTTA
TTATTTTGAAAAGGATGTTAAAGGTGAATCCTTGTTTCATTCTAAGAAAATGGACCTGACAGTAA
ATGGGGAACAACTGGATCTGGATCCTGGTCAAACTTTAATTTATTATGTTGATGAAAAAGCACCT
GAATTTTCAATGCAGGGTCTAAAAGGCGTACACTCCGACTACAAAGACGATGACGACAAGTCCCG
TACGAGATCTGGATCCCAATTGGACGGCGGGCTCGTGCTGTTCTCACACAGAGGAACCCTGGATG
GAGGCTTCCGCTTCCGCCTCTCTGACGGCGAGCACACTTCCCCCGGACACTTCTTCCGAGTGACG
GCCCAGAAGCAAGTGCTCCTCTCGCTGAAGGGCAGCCAGACACTGACTGTCTGCCCAGGGTCCGT
CCAGCCACTCAGCAGTCAGACCCTCAGGGCCAGCTCCAGCGCAGGCACTGACCCCCAGCTCCTGC
TCTACCGTGTGGTGCGGGGCCCCCAGCTAGGCCGGCTGTTCCACGCCCAGCAGGACAGCACAGGG
GAGGCCCTGGTGAACTTCACTCAGGCAGAGGTCTACGCTGGGAATATTCTGTATGAGCATGAGAT
GCCCCCCGAGCCCTTTTGGGAGGCCCATGATACCCTAGAGCTCCAGCTGTCCTCGCCGCCTGCCC
GGGACGTGGCCGCCACCCTTGCTGTGGCTGTGTCTTTTGAGGCTGCCTGTCCCAGCGCCCCAGC
CACCTCTGGAAGAACAAAGGTCTCTGGGTCCCCGAGGGCCAGCGGGCCAGGATCACCGTGGCTGC
TCTGGATGCCTCCAATCTCTTGGCCAGCGTTCCATCACCCCAGCGCTCAGAGCATGATGTGCTCT
TCCAGGTCACACAGTTCCCCAGCCGCGGCCAGCTGTTGGTGTCCGAGGAGCCCCTCCATGCTGGG
CAGCCCCACTTCCTGCAGTCCCAGCTGGCTGCAGGGCAGCTAGTGTATGCCCACGGCGGTGGGGG
CACCCAGCAGGATGCTTCCACTTTCGTGCCCACCTCCAGGGGCCAGCAGGGGCCTCCGTGGCTG
GACCCCAAACCTCAGAGGCCTTTGCCATCACGGTGAGGGATGTAAATGAGCGGCCCCTCAGCCA
CAGGCCTCTGTCCCACTCCGGCTCACCCGAGGCTCTCGTGCCCCATCTCCCGGGCCCAGCTGAG
TGTGGTGGACCCAGACTCAGCTCCTGGGGAGATTGAGTACGAGGTCCAGCGGGCACCCCACAACG
GCTTCCTCAGCCTGGTGGGTGGTGGCCTGGGGCCCGTGACCCGCTTCACGCAAGCCGATGTGGAT
TCAGGGCGGCTGGCCTTCGTGGCCAACGGGAGCAGCGTGGCAGGCATCTTCCAGCTGAGCATGTC
TGATGGGGCCAGCCCACCCCTGCCCATGTCCCTGGCTGTGGACATCCTACCATCCGCCATCGAGG
TGCAGCTGCGGGCACCCCTGGAGGTGCCCCAAGCTTTGGGGCGCTCCTCACTGAGCCAGCAGCAG
CTCCGGGTGGTTTCAGATCGGAGGCAGCCAGAGGCAGCATACCGGTTGATCCAGGGACCCCAGTA
TGGGCATCTCCTGGTGGGGGGCGGCCCACCTCGGCCTTCAGCCAATTCCAGATAGACCAGGGCG
AGGTGGTCTTTGCCTTCACCAACTCCTCCTCCTCTCATGACCACTTCAGAGTCCTGGCACTGGCT
AGGGGTGTCAATGCATCAGCCGTAGTGAACGTCACTGTGAGGGCTCTGCTGCATGTGTGGGCAGG
TGGGCCATGGCCCCAGGGTGCCACCCTGCGCCTGGACCCCACCGTCCTAGATGCTGGCGAGCTGG
CCAACCGCACAGATGTGCCGCGCTTCCGCCTCCTGGAGGGACCCCGGCATGCCGCGTGGTC
CGCGTGCCCCGAGCCAGGACGGAGCCCGGGGGCAGCCAGCTGGTGGAGCAGTTCACTCAGCAGGA
CCTTGAGGACGGGAGGCTGGGCCGGGAGGTGGGCAGGCCAGAGGGGAGGGCCCCCGGCCCCGCAG
GTGACAGTCTCACTCTGGAGCTGTGGGCACAGGGCGTCCCGCCTGCTGTGGCCTCCCTGGACTTT
GCCACTGAGCCTTACAATGCTGCCCGGCCCTACAGCGTGGCCCTGCTCAGTGTCCCCGAGGCCGC
CCGGACGGAAGCAGGGAAGCCAGAGAGCAGCACCCCCACAGGCGAGCCAGGCCCCATGGCATCCA
GCCCTGAGCCCGCTGTGGCCAAGGGAGGCTTCCTGAGCTTTCTAGAGGCCAACATGTTCAGCGTC
ATCATCCCCATGTGCCTGGTACTTCTGCTCCTGGCGCTCATCCTGCCCCTGCTCTTCTACCTCCG
AAAACGCAACAAGACGGGCAAGCATGACGTCCAGGTCCTGACTGCCAAGCCCCGCAACGGCCTGG
CTGGTGACACCGAGACCTTTCGCAAGGTGGAGCCAGGCCAGGCCATCCCGCTCACAGCTGTGCCT
GGCCAGGGGCCCCCTCCAGGAGGCCAGCCTGACCCAGAGCTGCTGCAGTTCTGCCGGACACCCAA
CCCTGCCCTTAAGAATGGCCAGTACTGGGTGTGA |

| SEQ ID NO. | DESIGNATION | SOURCE | TYPE | SEQUENCE |
|---|---|---|---|---|
| 192. | EpCAM-D3-hNG2 | artificial | aa | MGWSCIILFLVATATGVHSTATFAAAQEECVCENYKLAVNCFVNNNRQCQCTSVGAQNTVICSKL AAKCLVMKAEMNGSKLGRRAKPEGALQNNDGLYDPDCDESGLFKAKQCNGTSTCWCVNTAGVRRT DKDTEITCSERVRTYWIIIELKHKAREKPYDSKSLRTALQKEITTRYQLDPKFITSILYENNVIT IDLVQNSSQKTQNDVDIADVAYYFEKDVKGESLFHSKKMDLTVNGEQLDLDPGQTLIYYVDEKAP EFSMQGLKGVHSDYKDDDDKSRTRSGSQLDGGLVLFSHRGTLDGGFRFRLSDGEHTSPGHFFRVT AQKQVLLSLKGSQTLTVCPGSVQPLSSQTLRASSSAGTDPQLLLYRVVRGPQLGRLFHAQQDSTG EALVNFTQAEVYAGNILYEHEMPPEPFWEAHDTLELQLSSPPARDVAATLAVAVSFEAACPQRPS HLWKNKGLWVPEGQRARITVAALDASNLLASVPSPQRSEHDVLFQVTQFPSRGQLLVSEEPLHAG QPHFLQSQLAAGQLVYAHGGGGTQQDGFHFRAHLQGPAGASVAGPQTSEAFAITVRDVNERPPQP QASVPLRLTRGSRAPISRAQLSVVDPDSAPGEIEYEVQRAPHNGFLSLVGGGLGPVTRFTQADVD SGRLAFVANGSSVAGIFQLSMSDGASPPLPMSLAVDILPSAIEVQLRAPLEVPQALGRSSLSQQQ LRVVSDREEPEAAYRLIQGPQYGHLLVGGRPTSAFSQFQIDQGEVVFAFTNSSSSHDHFRVLALA RGVNASAVVNVTVRALLHVWAGGPWPQGATLRLDPTVLDAGELANRTDSVPRFRLLEGPRHGRVV RVPRARTEPGGSQLVEQFTQQDLEDGRLGLEVGRPEGRAPGPAGDSLTLELWAQGVPPAVASLDF ATEPYNAARPYSVALLSVPEAARTEAGKPESSTPTGEPGPMASSPEPAVAKGGFLSFLEANMFSV IIPMCLVLLLLALILPLLFYLRKRNKTGKHDVQVLTAKPRNGLAGDTETFRKVEPGQAIPLTAVP GQGPPPGGQPDPELLQFCRTPNPALKNGQYWV |
| 193. | EpCAM-D1D3-hNG2 | artificial | nt | ATGGGATGGAGCTGTATCATCCTCTTCTTGGTAGCAACAGCTACAGGTGTACACTCCACGGCGAC TTTTGCCGCAGCTCAGGAAGAATGTGTCTGTGAAAACTACAAGCTGGCCGTAAACTGCTTTGTGA ATAATAATCGTCAATGCCAGTGTACTTCAGTTGGTGCACAAAATACTGTCATTTGCTCAAAGCTG GCTGCCAAATGTTTGGTGATGAAGGCAGAAATGAATGGCTCAAAACTTGGGAGAAGAGCAAAACC TGAAGGGGCCCTCCAGAACAATGATGGGCTTTATGATCCTGACTGCGATGAGAGCGGGCTCTTTA AGGCCAAGCAGTGCAACGGCACCTCCACGTGCTGGTGTGTGAACACTGCTGGGGTCAGAAGAACA GACAAGGACACTGAAATAACCTGCTCTGAGCGAGTGAGAACCTACTGGATCATCATTGAACTAAA ACACAAAGCAAGAGAAAAACCTTATGATAGTAAAAGTTTGCGGACTGCACTTCAGAAGGAGATCA CAACGCGTTATCAACTGGATCCAAAATTTATCACGAGTATTTTGTATGAGAATAATGTTATCACT ATTGATCTGGTTCAAAATTCTTCTCAAAAAACTCAGAATGATGTGGACATAGCTGATGTGGCTTA TTATTTTGAAAAAGATGTTAAAGGTGAATCCTTGTTTCATTCTAAGAAAATGGACCTGACAGTGA ATGGGGAACAACTGGATCTGGATCCTGGTCAAACTTTAATTTATTATGTTGATGAAAAAGCACCT GAATTTTCAATGCAGGGTCTAAAAGGCGTACACTCCGACTACAAAGACGATGACGACAAGTCCGT ACACTCCGCTTCCTTCTTCGGTGAGAACCACCTGGAGGTGCCTGTGGCCACGGCTCTGACCGACA TAGACCTGCAGCTGCAGTTCTCCACGTCCCAGCCCGAAGCCCTTCTTCTCCTGGCAGCAGGCCCA GCTGACCACCTCCTGCTGCAGCTCTACTCTGGACGCCTGCAGGTCAGACTTGTTCTGGGCCAGGA GGAGCTGAGGCTGCAGACTCCAGCAGAGACGCTGCTGAGTGACTCCATCCCCCACACTGTGGTGC TGACTGTCGTAGAGGGCTGGGCCACGTTGTCAGTCGATGGGTTTCTGAACGCCTCCTCAGCAGTC CCAGGAGCCCCCCTAGAGGTCCCCTATGGGCTCTTTGTTGGGGGCACTGGGACCCTTGGCCTGCC CTACCTGAGGGGAACCAGCCGACCCCTGAGGGGTTGCCTCCATGCAGCCACCCTCAATGGCCGCA GCCTCCTCCGGCCTCTGACCCCCGATGTGCATGAGGGCTGTGCTGAAGAGTTTTCTGCCAGTGAT GATGTGGCCCTGGCTTCTCTGGGCCCCACTCTCTGGCTGCCTTCCCTGCCTGGGGCACTCAGGA CGAAGGAACCCTCGAGTTTACACTCACCACACAGAGCCGGCAGGCACCCTTGGCCTTCCAGGCAG GGGGCCGGCGTGGGGACTTCATCTATGTGGACATATTTGAGGGCCACCTGCCGGCCGTGGTGGAG AAGGGCCAGGGTACCGTATTGCTCCACAACAGTGTGCCTGTGGCCGATGGGCAGCCCCATGAGGT CAGTGTCCACATCAATGCTCACCGGCTGGAAATCTCCGTGGACCAGTACCCTACGCATACTTCGA ACCGAGGAGTCCTCAGCTACCTGGAGCCACGGGCAGTCTCCTTCTCGGGGGGCTGGATGCAGAG GCCTCTCGTCACCTCCAGGAACACCGCCTGGGCCTGACACCAGAGGCCACCAATGCCTCCCTGCT GGGCTGCATGGAAGACCTCAGTGTCAATGGCCAGAGGCGGGGGCTGCGGGAAGCTTTGCTGACGC GCAACATGGCAGCCGGCTGCAGGCTGGAGGAGGAGGAGTATGAGGACGATGCCTATGGCCATTAT GAAGCTTTCTCCACCCTGGCTCCCGAGGCTTGGCCAGCCATGGAGCTGCCTGAGCCATGCGTGCC TGAGCCAGGGCTGCCTCCTGTCTTTGCCAATTTCACCCAGCTGCTGACTATCAGCCCACTAGTGG TGGCCGAGGGTGGCACAGCCTGGCTTGAGTGGAGGCATGTGCAGCCCACGCTGGACCTGATGGAG GCTGAGCTGCGCAAATCCCAGGTGCTGTTCAGCGTGACCCGAGGGGCACACTATGGCGAGCTCGA GCTGGACATCCTGGGTGCCCAGGCACGAAAAATGTTCACCCTCCTGGACGTGGTGAACCGCAAGG CCCGCTTCATCCACGATGGCTCTGAGGACACCTCCGACCAGCTGGTGCTGGAGGTGTCGGTGACG GCTCGGGTGCCCATGCCCTCATGCCTTCGGAGGGGCCAAACATACCTCCTGCCCATCCAGGTCAA CCCTGTCAATGACCCACCCCACATCATCTTCCCACATGGCAGCCTCATGGTGATCCTGGAACACA CGCAGAAGCCGCTGGGGCCTGAGGTTTTCCAGGCCTATGACCCGGACTCTGCCTGTGAGGGCCTC ACCTTCCAGGTCCTTGGCACCTCCTCTGGCCTCCCCGTGGAGCGCCGAGACCAGCCTGGGGAGCC GGCGACCGAGTTCTCCTGCCGGGAGTTGGAGGCCGGCAGCCTAGTCTATGTCCACTGCGGTGGTC CTGCACAGGACTTGACGTTCCGGGTCAGCGATGGACTGCAGGCCAGCCCCCGGCCACGCTGAAG GTGGTGGCCATCCGGCCGGCCATACAGATCCACAGATCTCAATTGGACGGCGGGCTCGTGCTGTT CTCACACAGAGGAACCCTGGATGGAGGCTTCCGCTTCCGCCTCTCTGACGGCGAGCACACTTCCC CCGGACACTTCTTCCGAGTGACGGCCCAGAAGCAAGTGCTCCTCTCGCTGAAGGGCAGCCAGACA CTGACTGTCTGCCCAGGGTCCGTCCAGCCACTCAGCAGTCAGACCCTCAGGGCCAGCTCCAGCGC AGGCACTGACCCCAGCTCCTGCTCTACCGTGTGGTGCGGGGCCCCAGCTAGGCCGGCTGTTCC ACGCCCAGCAGGACAGCACAGGGGAGGCCCTGGTGAACTTCACTCAGGCAGAGGTCTACGCTGGG AATATTCTGTATGAGCATGAGATGCCCCCGAGCCCTTTTGGGAGGCCCATGATACCCTAGAGCT CCAGCTGTCCTCGCCGCCTGCCCGGGACGTGGCCGCCACCCTTGCTGTGGCTGTGTCTTTTGAGG CTGCCTGTCCCCAGCGCCCCAGCCACCTCTGGAAGAACAAAGGTCTCTGGGTCCCCGAGGGCCAG CGGGCCAGGATCACCGTGGCTGCTCTGGATGCCTCCAATCTCTTGGCCAGCGTTCCATCACCCCA GCGCTCAGAGCATGATGTGCTCTTCCAGGTCACACAGTTCCCCAGCCGCGGCCAGCTGTTGGTGT CCGAGGAGCCCCTCCATGCTGGGCAGCCCCACTTCCTGCAGTCCCAGCTGGCTGCAGGGCAGCTA GTGTATGCCCACGGCGGTGGGGGCACCCAGCAGGATGGCTTCCACTTTCGTGCCCACCTCCAGGG GCCAGCAGGGGCCTCCGTGGCTGGACCCCAAACCTCAGAGGCCTTTGCCATCACGGTGAGGGATG |

| SEQ ID NO. | DESIGNATION | SOURCE | TYPE | SEQUENCE |
|---|---|---|---|---|
| | | | | TAAATGAGCGGCCCCCTCAGCCACAGGCCTCTGTCCCACTCCGGCTCACCCGAGGCTCTCGTGCC<br>CCCATCTCCCGGGCCCAGCTGAGTGTGGTGGACCCAGACTCAGCTCCTGGGGAGATTGAGTACGA<br>GGTCCAGCGGGCACCCCACAACGGCTTCCTCAGCCTGGTGGGTGGTGGCCTGGGGCCCGTGACCC<br>GCTTCACGCAAGCCGATGTGGATTCAGGGCGGCTGGCCTTCGTGGCCAACGGGAGCAGCGTGGCA<br>GGCATCTTCCAGCTGAGCATGTCTGATGGGGCCAGCCCACCCCTGCCCATGTCCCTGGCTGTGGA<br>CATCCTACCATCCGCCATCGAGGTGCAGCTGCGGGCACCCCTGGAGGTGCCCCAAGCTTTGGGGC<br>GCTCCTCACTGAGCCAGCAGCAGCTCCGGGTGGTTTCAGATCGGGAGGAGCCAGAGGCAGCATAC<br>CGGTTGATCCAGGGACCCCAGTATGGGCATCTCCTGGTGGGCGGGCGGCCCACCTCGGCCTTCAG<br>CCAATTCCAGATAGACCAGGGCGAGGTGGTCTTTGCCTTCACCAACTCCTCCTCCTCTCATGACC<br>ACTTCAGAGTCCTGGCACTGGCTAGGGGTGTCAATGCATCAGCCGTAGTGAACGTCACTGTGAGG<br>GCTCTGCTGCATGTGTGGGCAGGTGGGCCATGGCCCCAGGGTGCCACCCTGCGCCTGGACCCCAC<br>CGTCCTAGATGCTGGCGAGCTGGCCAACCGCACAGACAGTGTGCCGCGCTTCCGCCTCCTGGAGG<br>GACCCCGGCATGGCCGCTGGTCCGCGTGCCCCGAGCCAGGACGGAGCCCGGGGCGCAGCCAGCTG<br>GTGGAGCAGTTCACTCAGCAGGACCTTGAGGACGGGAGGCTGGGGGTGGAGGTGGGCAGGCCAGA<br>GGGGAGGGCCCCGGCCCCGCAGGTGACAGTCTCACTCTGGAGCTGTGGGCACAGGGCGTCCCGC<br>CTGCTGTGGCCTCCCTGGACTTTGCCACTGAGCCTTACAATGCTGCCCGGCCCTACAGCGTGGCC<br>CTGCTCAGTGTCCCCGAGGCCGCCCGGACGGAAGCAGGGAAGCCAGAGAGCAGCACCCCCACAGG<br>CGAGCCAGGCCCCATGGCATCCAGCCCTGAGCCCGCTGTGGCCAAGGGAGGCTTCCTGAGCTTTC<br>TAGAGGCCAACATGTTCAGCGTCATCATCCCCATGTGCCTGGTACTTCTGCTCCTGGCGCTCATC<br>CTGCCCCTGCTCTTCTACCTCCGAAAACGCAACAAGACGGGCAAGCATGACGTCCAGGTCCTGAC<br>TGCCAAGCCCCGCAACGGCCTGGCTGGTGACACCGAGACCTTTCGCAAGGTGGAGCCAGGCCAGG<br>CCATCCCGCTCACAGCTGTGCCTGGCCAGGGGCCCCCTCCAGGAGGCCAGCCTGACCCAGAGCTG<br>CTGCAGTTCTGCCGGACACCCAACCCTGCCCTTAAGAATGGCCAGTACTGGGTGTGA |
| 194. | EpCAM-D1D3-hNG2 | artificial | aa | MGWSCIILFLVATATGVHSTATFAAAQEECVCENYKLAVNCFVNNNRQCQCTSVGAQNTVICSKL<br>AAKCLVMKAEMNGSKLGRRAKPEGALQNNDGLYDPDCDESGLFKAKQCNGTSTCWCVNTAGVRRT<br>DKDTEITCSERVRTYWIIIELKHKAREKPYDSKSLRTALQKEITTRYQLDPKFITSILYENNVIT<br>IDLVQNSSQKTQNDVDIADVAYYFEKDVKGESLFHSKKMDLTVNGEQLDLDPGQTLIYYVDEKAP<br>EFSMQGLKGVHSDYKDDDDKSVHSASFFGENHLEVPVATALTDIDLQLQFSTSQPEALLLLAAGP<br>ADHLLLQLYSGRLQVRLVLGQEELRLQTPAETLLSDSIPHTVVLTVVEGWATLSVDGFLNASSAV<br>PGAPLEVPYGLFVGGTGTLGLPYLRGTSRPLRGCLHAATLNGRSLLRPLTPDVHEGCAEEFSASD<br>DVALGFSGPHSLAAFPAWGTQDEGTLEFTLTTQSRQAPLAFQAGGRRGDFIYVDIFEGHLRAVVE<br>KGQGTVLLHNSVPVADGQPHEVSVHINAHRLEISVDQYPTHTSNRGVLSYLEPRGSLLLGGLDAE<br>ASRHLQEHRLGLTPEATNASLLGCMEDLSVNGQRRGLREALLTRNMAAGCRLEEEEYEDDAYGHY<br>EAFSTLAPEAWPAMELPEPCVPEPGLPPVFANFTQLLTISPLVVAEGGTAWLEWRHVQPTLDLME<br>AELRKSQVLFSVTRGAHYGELELDILGAQARKMFTLLDVVNRKARFIHDGSEDTSDQLVLEVSVT<br>ARVPMPSCLRRGQTYLLPIQVNPVNDPPHIIFPHGSLMVILEHTQKPLGPEVFQAYDPDSACEGL<br>TFQVLGTSSGLPVERRDQPGEPATEFSCRELEAGSLVYVHCGGPAQDLTFRVSDGLQASPPATLK<br>VVAIRPAIQIHRSQLDGGLVLFSHRGTLDGEHTSPGHFFRVTAQKQVLLSLKGSQT<br>LTVCPGSVQPLSSQTLRASSSAGTDPQLLLYRVVRGPQLGRLFHAQQDSTGEALVNFTQAEVYAG<br>NILYEHEMPPEPFWEAHDTLELQLSSPPARDVAATLAVAVSFEAACPQRPSHLWKNKGLWVPEGQ<br>RARITVAALDASNLLASVPSPQRSEHDVLFQVTQPFSRGQLLVSEEPLHAGQPHFLQSQLAAGQL<br>VYAHGGGGTQQDGFHFRAHLQGPAGASVAGPQTSEAFAITVRDVNERPPQPQASVPLRLTRGSRA<br>PISRAQLSVVDPDSAPGEIEYEVQRAPHNGFLSLVGGGLGPVTRFTQADVDSGRLAFVANGSSVA<br>GIFQLSMSDGASPPLPMSLAVDILPSAIEVQLRAPLEVPQALGRSSLSQQQLRVVSDREEPEAAY<br>RLIQGPQYGHLLVGGRPTSAFSQFQIDQGEVVFAFTNSSSSHDHFRVLALARGVNASAVVNVTVR<br>ALLHVWAGGPWPQGATLRLDPTVLDAGELANRTDSVPRFRLLEGPRHGRVRVPRARTEPGGSQL<br>VEQFTQQDLEDGRLGLEVGRPEGRAPGPAGDSLTLELWAQGVPPAVASLDFATEPYNAARPYSVA<br>LLSVPEAARTEAGKPESSTPTGEPGPMASSPEPAVAKGGFLSFLEANMFSVIIPMCLVLLLLALI<br>LPLLFYLRKRNKTGKHDVQVLTAKPRNGLAGDTETFRKVEPGQAIPLTAVPGQGPPPGGQPDPEL<br>LQFCRTPNPALKNGQYWV |
| 195. | EpCAM-D1D2-hNG2 | artificial | nt | ATGGGATGGAGCTGTATCATCCTCTTCTTGGTAGCAACAGCTACAGGTGTACACTCCACAGCGAC<br>TTTTGCCGCAGCTCAGGAAGAATGTGTCTGTGAAAACTACAAGCTGGCCGTAAACTGCTTTGTGA<br>ATAATAATCGTCAATGCCAGTGTACTTCAGTTGGTGCACAAAATACTGTCATTTGCTCAAAGCTG<br>GCTGCCAAATGTTTGGTGATGAAGGCAGAAATGAATGGCTCAAAACTTGGGAGAAGAGCAAAACC<br>TGAAGGGGCCCTCCAGAACAATGATGGGCTTTATGATCCTGACTGCGATGAGAGCGGGCTCTTTA<br>AGGCCAAGCAGTGCAACGGCACCTCCACGTGCTGGTGTGTGAACACTGCTGGGGTCAGAAGAACA<br>GACAAGGACACTGAAATAACCTGCTCTGAGCGAGTGAGAACCTACTGGATCATCATTGAACTAAA<br>ACACAAAGCAAGAGAAAAACCTTATGATAGTAAAAGTTTGCGGACTGCACTTCAGAAGGAGATCA<br>CAACGCGTTATCAACTGGATCCAAAATTTATCACGAGTATTTTGTATGAGAATAATGTTATCACT<br>ATTGATCTGGTTCAAAATTCTTCTCAAAAAACTCAGAATGATGTGGACATAGCTGATGTGGCTTA<br>TTATTTTGAAAAAGATGTTAAAGGTGAATCCTTGTTTCATTCTAAGAAAATGGACCTGACAGTAA<br>ATGGGGAACAACTGGATCTGGATCCTGGTCAAACTTTAATTTATTATGTTGATGAAAAAGCACCT<br>GAATTTTCAATGCAGGGTCTAAAAGGCGTACACTCCGACTACAAAGACGATGACGACAAGTCCGT<br>ACACTCCGCTTCCTTCTTCGGTGAGAACCACCTGGAGGTGCCTGTGGCCACGGCTCTGACCGACA<br>TAGACCTGCAGCTGCAGTTCTCCACGTCCCAGCCCGAAGCCCTCCTTCTCCTGGCAGCAGGCCCA<br>GCTGACCACCTCCTGCTGCAGCTCTACTCTGGACGCCTGCAGGTCAGACTTGTTCTGGGCCAGGA<br>GGAGCTGAGGCTGCAGACTCCAGCAGAGACGCTGCTGAGTGACTCCATCCCCCACACTGTGGTGC<br>TGACTGTCGTAGAGGGCTGGGCCACGTTGTCAGTCGATGGGTTTCTGAACGCCTCCTCAGCAGTC<br>CCAGGAGCCCCCTAGAGGTCCCCTATGGGCTCTTTGTTGGGGGCACTGGGACCCTTGGCCTGCC<br>CTACCTGAGGGGAACCAGCCGACCCCTGAGGGGTTGCCTCCATGCAGCCACCCTCAATGGCCGCA<br>GCCTCCTCCGGCCTCTGACCCCCGATGTGCATGAGGGCTGTGCTGAAGAGTTTTCTGCCAGTGAT<br>GATGTGGCCCTGGGCTTCTCTGGGCCCCACTCTCTGGCTGCCTTTCCCTGCCTGGGGCACTCAGGA<br>CGAAGGAACCCTCGAGTTTACACTCACCACACAGAGCCGGCAGGCACCCTTGGCCTTCCAGGCAG |

| SEQ ID NO. | DESIGNATION | SOURCE | TYPE | SEQUENCE |
|---|---|---|---|---|
| | | | | GGGGCCGGCGTGGGGACTTCATCTATGTGGACATATTTGAGGGCCACCTGCGGGCCGTGGTGGAG<br>AAGGGCCAGGGTACCGTATTGCTCCACAACAGTGTGCCTGTGGCCGATGGGCAGCCCCATGAGGT<br>CAGTGTCCACATCAATGCTCACCGGCTGGAAATCTCCGTGGACCAGTACCCTACGCATACTTCGA<br>ACCGAGGAGTCCTCAGCTACCTGGAGCCACGGGGCAGTCTCCTTCTCGGGGGGCTGGATGCAGAG<br>GCCTCTCGTCACCTCCAGGAACACCGCCTGGGCCTGACACCAGAGGCCACCAATGCCTCCCTGCT<br>GGGCTGCATGGAAGACCTCAGTGTCAATGGCCAGAGGCGGGGGCTGCGGGAAGCTTTGCTGACGC<br>GCAACATGGCAGCCGGCTGCAGGCTGGAGGAGGAGGAGTATGAGGACGATGCCTATGGCCATTAT<br>GAAGCTTTCTCCACCCTGGCTCCCGAGGCTTGGCCAGCCATGGAGCTGCCTGAGCCATGCGTGCC<br>TGAGCCAGGGCTGCCTCCTGTCCTTTGCCAATTTCACCCAGCTGCTGACTATCAGCCCACTAGTGG<br>TGGCCGAGGGTGGCACAGCCTGGCTTGAGTGGAGGCATGTGCAGCCCACGCTGGACCTGATGGAG<br>GCTGAGCTGCGCAAATCCCAGGTGCTGTTCAGCGTGACCCGAGGGGCACACTATGGCGAGCTCGA<br>GCTGGACATCCTGGGTGCCCAGGCACGAAAAATGTTCACCCTCCTGGACGTGGTGAACCGCAAGG<br>CCCGCTTCATCCACGATGGCTCTGAGGACACCTCCGACCAGCTGGTGCTGGAGGTGTCGGTGACG<br>GCTCGGGTGCCCATGCCCTCATGCCTTCGGAGGGGCCAAACATACCTCCTGCCCATCCAGGTCAA<br>CCCTGTCAATGACCCACCCCACATCATCTTCCCACATGGCAGCCTCATGGTGATCCTGGAACACA<br>CGCAGAAGCCGCTGGGGCCTGAGGTTTTCCAGGCCTATGACCCGGACTCTGCCTGTGAGGGCCTC<br>ACCTTCCAGGTCCTTGGCACCTCCTCTGGCCTCCCCGTGGAGCGCCGAGACCAGCCTGGGGAGCC<br>GGCGACCGAGTTCTCCTGCCGGGAGTTGGAGGCCGGCAGCCTAGTCTATGTCCACTGCCGGTGGTC<br>CTGCACAGGACTTGACGTTCCGGGTCAGCGATGGACTGCAGGCCAGCCCCCGGCCACGCTGAAG<br>GTGGTGGCCATCCGGCCGGCCATACAGATCCACAGATCTACAGGGTTGCGACTGGCCCAAGGCTC<br>TGCCATGCCCATCTTGCCCGCCAACCTGTCGGTGGAGACCAATGCCGTGGGGCAGGATGTGAGCG<br>TGCTGTTCCGCGTCACTGGGGGCCCTGCAGTTTGGGGAGCTGCAGAAGCATAGTACAGGTGGGGTG<br>GAGGGTGCTGAGTGGTGGGCCACACAGGCGTTCCACCAGCGGGATGTGGAGCAGGGCCGCGTGAG<br>GTACCTGAGCACTGACCCACAGCACCACGCTTACGACACCGTGGAGAACCTGGCCCTGGAGGTGC<br>AGGTGGGCCAGGAGATCCTGAGCAATCTGTCCTTCCCAGTGACCATCCAGAGAGCCACTGTGTGG<br>ATGCTGCGGCTGGAGCACTGCACACTCAGAACACCCAGCAGGAGACCCTCACCACAGCCCACCT<br>GGAGGCCACCCTGGAGGAGGCAGGCCCAAGCCCCCAACCTTCCATTATGAGGTGGTTCAGGCTC<br>CCAGGAAAGGCAACCTTCAACTACAGGGCACAAGGCTGTCAGATGGCCAGGGCTTCACCCAGGAT<br>GACATACAGGCTGGCCGGGTGACCTATGGGGCCACAGCTCGTGCCTCAGAGGCAGTCGAGGACAC<br>CTTCCGTTTCCGTGTCACGGCGCCACCATATTTCTCCCCACTCTATACCTTCCCCATCCACATTG<br>GTGGTGACCCAGATGCGCCTGTCCTCACCAATGTCCTCCTCGTGGTGCCTGAGGGTGGTGAGGGT<br>GTCCTCTCTGCTGACCACCTCTTTGTCAAGAGTCTCAACAGTGCCAGCTACCTCTATGAGGTCAT<br>GGAGCGGCCCCGCCTTGGGAGGTTGGCTTGGCGTGGGACACAGGACAAGACCACTATGGTGACAT<br>CCTTCACCAATGAAGACCTGTTGCGTGGCCGGCTGGTCTACCAGCATGATGACTCCGAGACCACA<br>GAAGATGATATCCCATTTGTTGCTACCCGCCAGGGCGAGAGCAGTGGTGACATGGCCTGGGAGGA<br>GGTACGGGGTGTCTTCCGAGTGGCCATCCAGCCCGTGAATGACCACGCCCCTGTGCAGACCATCA<br>GCCGGATCTTCCATGTGGCCCGGGTGGGCGGCGGCTGCTGACTACAGACGACGTGGCCTTCAGC<br>GATGCTGACTCGGGCTTTGCTGACGCCCAGCTGGTGCTTACCCGCAAGGACCTTCCTCTTTGGCAG<br>TATCGTGCCGTAGATGAGCCCACGCGGCCCATCTACCGCTTCACCCAGGAGGACCTCAGGAAGA<br>GGCGAGTACTGTTCGTGCACTCAGGGGCTGACCGTGGCTGGATCCAGCTGCAGGTGTCCGACGGG<br>CAACACCAGGCCACTGCGCTGCTGGAGGTGCAGGCCTCGGAACCCTACCTCCGTGTGGCCAACGG<br>CTCCAGCCTTGTGGTCCCTCAAGGAGGCCAGGGCACCATCGACACGGCCGTGCTCCACCTGGACA<br>CCAACCTCGACATCCGCAGTGGGGATGAGGTCCACTACCACGTCACAGCTGGCCCTCGCTGGGGA<br>CAACTAGTCCGGGCTGGTCAGCCAGCCACAGCCTTCTCCCAGCAGGACCTGCTGGATGGGGCCGT<br>TCTCTATAGCCACAATGGCAGCCTCAGCCCCGAAGACACCATGGCCTTCTCCGTGGAAGCAGGGC<br>CAGTGCACACGGATGCCCACCCTACAAGTGACCATTGCCCTAGAGGGCCCACTGGCCCCACTGAAG<br>CTGGTCCGGCACAAGAAGATCTACGTCTTCCAGGGAGAGGCAGCTGAGATCAGAAGGGACCAGCT<br>GGAGGCAGCCCAGGAGGCAGTGCCACCTGCAGACATCGTATTCTCAGTGAAGAGCCCACCGAGTG<br>CCGGCTACCTGGTGATGGTGTCGCGTGGCGCCTTGGCAGATGAGCCACCCAGCCTGGACCCTGTG<br>CAGAGCTTCTCCCAGGAGGCAGTGGACACAGGCAGGGTCCTGTACCTGCACTCTAGACCTGAGGC<br>CTGGAGCGATGCCTTCTCGCTGGATGTGGCCTCAGGCCTGGGTGCTCCCCTCGAGGGCGTCCTTG<br>TGGAGCTGGAGGTGCTGCCCGCTGCCATCCCACTAGAGGCGCAAAACTTCAGCGTCCCTGAGGGT<br>GGCAGCCTCACCCTGGCCCCTCCACTGCTCCGTGTCTCGGGCCCTACTTCCCCACTCTCCTGGG<br>CCTCAGCCTGCAGGTGCTGGAGCCACCCCAGCATGGACCCCTGCAGAAGGAGGACGGACCTCAAG<br>CCAGGACCCTCAGCGCCTTCTCCTGGAGAATGGTGGAAGAGCAGCTGATCCGCTACGTGCATGAC<br>GGGAGCGAGACACTGACAGACAGTTTTGTCCTGATGGCTAATGCCTCCGAGATGGATCGCCAGAG<br>CCATCCTGTGGCCTTCACTGTCACTGTCCTGCCTGTCAATGACCAACCCCCATCCTCACTACAA<br>ACACAGGCCTGCAGATGTGGGAGGGGCCACTGCGCCCATCCCTGCGGAGGCTCTGAGGAGCACG<br>GACGGCGACTCTGGGTCTGAGGATCTGGTCTACACCATCGAGCAGCCCAGCAACGGGCGGGTAGT<br>GCTGCGGGGGGCGCCGGGCACTGAGGTGCGCAGCTTCACGCAGGCCCAATTGTTTCTAGAGGCCA<br>ACATGTTCAGCGTCATCATCCCCATGTGCCTGGTACTTCTGCTCCTGGCGCTCATCCTGCCCCTG<br>CTCTTCTACCTCCGAAAACGCAACAAGACGGGCAAGCATGACGTCCAGGTCCTGACTGCCAAGCC<br>CCGCAACGGCCTGGCTGGTGACACCGAGACCTTTCGCAAGGTGGAGCCAGGCCAGGCCATCCCGC<br>TCACAGCTGTGCCTGGCCAGGGGCCCCTCCAGGAGGCCAGCCTGACCCAGAGCTGCTGCAGTTC<br>TGCCGGACACCCAACCCTGCCCTTAAGAATGGCCAGTACTGGGTGTGA |
| 196. | EpCAM-D1D2-hNG2 | artificial | aa | MGWSCIILFLVATATGVHSTATFAAAQEECVCENYKLAVNCFVNNNRQCQCTSVGAQNTVICSKL<br>AAKCLVMKAEMNGSKLGRRAKPEGALQNNDGLYDPDCDESGLFKAKQCNGTSTCWCVNTAGVRRT<br>DKDTEITCSERVRTYWIIIELKHKAREKPYDSKSLRTALQKEITTRYQLDPKFITSILYENNVIT<br>IDLVQNSSQKTQNDVDIADVAYYFEKDVKGESLFHSKKMDLTVNGEQLDLDPGQTLIYYVDEKAP<br>EFSMQGLKGVHSDYKDDDDKSVHSASFFGENHLEVPVATALTDIDLQLQFSTSQPEALLLLAAGP<br>ADHLLLQLYSGRLQVRLVLGQEELRLQTPAETLLSDSIPHTVVLTVVEGWATLSVDGFLNASSAV<br>PGAPLEVPYGLFVGGTGTLGLPYLRGTSRPLRGCLHAATLNGRSLLRPLTPDVHEGCAEEFSASD<br>DVALGFSGPHSLAAFPAWGTQDEGTLEFTLTTQSRQAPLAFQAGGRRGDFIYVDIFEGHLRAVVE<br>KGQGTVLLHNSVPVADGQPHEVSVHINAHRLEISVDQYPTHTSNRGVLSYLEPRGSLLLGGLDAE |

| SEQ ID NO. | DESIGNATION | SOURCE | TYPE | SEQUENCE |
|---|---|---|---|---|
| | | | | ASRHLQEHRLGLTPEATNASLLGCMEDLSVNGQRRGLREALLTRNMAAGCRLEEEEYEDDAYGHY EAFSTLAPEAWPAMELPEPCVPEPGLPPVFANFTQLLTISPLVVAEGGTAWLEWRHVQPTLDLME AELRKSQVLFSVTRGAHYGELELDILGAQARKMFTLLDVVNRKARFIHDGSEDTSDQLVLEVSVT ARVPMPSCLRRGQTYLLPIQVNPVNDPPHIIFPHGSLMVILEHTQKPLGPEVFQAYDPDSACEGL TFQVLGTSSGLPVERRDQPGEPATEFSCRELEAGSLVYVHCGGPAQDLTFRVSDGLQASPPATLK VVAIRPAIQIHRSTGLRLAQGSAMPILPANLSVETNAVGQDVSVLFRVTGALQFGELQKHSTGGV EGAEWWATQAFHQRDVEQGRVRYLSTDPQHHAYDTVENLALEVQVGQEILSNLSFPVTIQRATVW MLRLEPLHTQNTQQETLTTAHLEATLEEAGPSPPTFHYEVVQAPRKGNLQLQGTRLSDGQGFTQD DIQAGRVTYGATARASEAVEDTFRFRVTAPPYFSPLYTFPIHIGGDPDAPVLTNVLLVVPEGGEG VLSADHLFVKSLNSASYLYEVMERPRLGRLAWRGTQDKTTMVTSFTNEDLLRGRLVYQHDDSETT EDDIPFVATRQGESSGDMAWEEVRGVFRVAIQPVNDHAPVQTISRIFHVARGGRRLLTTDDVAFS DADSGFADAQLVLTRKDLLFGSIVAVDEPTRPIYRFTQEDLRKRRVLFVHSGADRGWIQLQVSDG QHQATALLEVQASEPYLRVANGSSLVVPQGGQGTIDTAVLHLDTNLDIRSGDEVHYHVTAGPRWG QLVRAGQPATAFSQQDLLDGAVLYSHNGSLSPEDTMAFSVEAGPVHTDATLQVTIALEGPLAPLK LVRHKKIYVFQGEAAEIRRDQLEAAQEAVPPADIVFSVKSPPSAGYLVMVSRGALADEPPSLDPV QSFSQEAVDTGRVLYLHSRPEAWSDAFSLDVASGLGAPLEGVLVELEVLPAAIPLEAQNFSVPEG GSLTLAPPLLRVSGPYFPTLLGLSLQVLEPPQHGPLQKEDGPQARTLSAFSWRMVEEQLIRYVHD GSETLTDSFVLMANASEMDRQSHPVAFTVTVLPVNDQPPILTTNTGLQMWEGATAPIPAEALRST DGDSGSEDLVYTIEQPSNGRVVLRGAPGTEVRSFTQAQLFLEANMFSVIIPMCLVLLLLALILPL LFYLRKRNKTGKHDVQVLTAKPRNGLAGDTETFRKVEPGQAIPLTAVPGQGPPPGGQPDPELLQF CRTPNPALKNGQYWV |
| 197. | EpCAM-hNG2 | artificial | nt | ATGGGATGGAGCTGTATCATCCTCTTCTTGGTAGCAACAGCTACAGGTGTACACTCCACGGCGAC TTTTGCCGCAGCTCAGGAAGAATGTGTCTGTGAAAACTACAAGCTGGCCGTAAACTGCTTTGTGA ATAATAATCGTCAATGCCAGTGTACTTCAGTTGGTGCACAAAATACTGTCATTTGCTCAAAGCTG GCTGCCAAATGTTTGGTGATGAAGGCAGAAATGAATGGCTCAAAACTTGGGAGAAGAGCAAAACC TGAAGGGGCCCTCCAGAACAATGATGGGCTTTATGATCCTGACTGCGATGAGAGCGGGCTCTTTA AGGCCAAGCAGTCAACGGCACCTCCACGTGCTGGTGTGTGAACACTGCTGGGGTCAGAAGAACA GACAAGGACACTGAAATAACCTGCTCTGAGCGAGTGAGAACCTACTGGATCATCATTGAACTAAA ACACAAAGCAAGAGAAAAAACCTTATGATAGTAAAAGTTTGCGGACTGCACTTCAGAAGGAGATCA CAACGCGTTATCAACTGGATCCAAAATTTATCACGAGTATTTTGTATGAGAATAATGTTATCACT ATTGATCTGGTTCAAAATTCTTCTCAAAAAACTCAGAATGATGTGGACATAGCTGATGTGGCCTTA TTATTTTGAAAAAGATGTTAAAGGTGAATCCTTGTTTCATTCTAAGAAAATGGACCTGACAGTAA ATGGGGAACAACTGGATCTGGATCCTGGTCAAACTTTAATTTATTATGTTGATGAAAAAAGCACCT GAATTTTCAATGCAGGGTCTAAAAGGCGTACACTCCGACTACAAAGACGATGACGACAAGTCCGT ACACTCCGCTTCCTTCTTCGGTGAGAACCACCTGGAGGTGCCTGTGGCCACGGCTCTGACCGACA TAGACCTGCAGCTGCAGTTCTCCACGTCCCAGCCCGAAGCCCTCCTTCCTGGCAGCAGGCCCA GCTGACCACCTGCTGCAGCTCCTACTCTGGACGCCTGCAGGTCAGACTTGTTCTGGGCCAGGA GGAGCTGAGGCTGCAGACTCCAGCAGAGACGCTGCTGAGTGACTCCATCCCCCACACTGTGGTGC TGACTGTCGTAGAGGGCTGGGCCACGTTGTCAGTCGATGGGTTTCTGAACGCCTCCTCAGCAGTC CCAGGAGCCCCCCTAGAGGTCCCCTATGGGCTCTTTGTTGGGGGCACTGGGACCCTTGGCCTGCC CTACCTGAGGGGAACCAGCCGACCCCTGAGGGGTTGCCTCCATGCAGCCACCCTCAATGGCCGCA GCCTCCTCCGGCCTCTGACCCCCGATGTGCATGAGGGCTGTGCTGAAGAGTTTTCTGCCAGTGAT GATGTGGCCCTGGGCTTCTCTGGGCCCCACTCTCTGGCTGCCTTCCCTGCCTGGGCACTCAGGA CGAAGGAACCCTCGAGTTTACACTCACCACACAGAGCCGGCAGGCACCCTTGGCCTTCAGGCAG GGGGCCGGCGTGGGGACTTCATCTATGTGGACATATTTGAGGGCCACCTGCGGGCCGTGGTGGAG AAGGGCCAGGGTACCGTATTGCTCCACAACAGTGTGCCTGTGGCCGATGGGCAGCCCCATGAGGT CAGTGTCCACATCAATGCTCACCGGCTGGAAATCTCCGTGGACCCAGTACCCTACGCATACTTCGA ACCGAGGAGTCCTCAGCTACCTGGAGCCACGGGGCAGTCTCCTTCTCGGGGGGCTGGATGCAGAG GCCTCTCGTCACCTCCAGGAACACCGCCTGGGCCTGACACCAGAGGCCACCAATGCCTCCCTGCT GGGCTGCATGGAAGACCTCAGTGTCAATGGCCAGAGGCGGGGGCTGCGGGAAGCTTTGCTGACGC GCAACATGGCAGCGGCTGCAGGCTGGAGGAGGAGGAGTATGAGGACGATGCCTATGGCCATTAT GAAGCTTTCTCCACCCTGGCTCCCGAGGCTTGGCCAGCCATGGAGCTGCCTGAGCCATGCGTGCC TGAGCCAGGGCTGCCTCCTGTCTTTGCCAATTTCACCCAGCTGCTGACTATCAGCCCACTAGTGG TGGCCGAGGGTGGCACAGCCTGGCTTGAGTGGAGGCATGTGCAGCCCACGCTGGACCTGATGGAG GCTGAGCTGCGCAAATCCCAGGTGCTGTTCAGCGTGACCCGAGGGGCACACTATGGCGAGCTCGA GCTGGACATCCTGGGTGCCCAGGCACGAAAAATGTTCACCCTCCTGGACGTGGTGAACCGCAAGG CCCGCTTCATCCACGATGGCTCTGAGGACACCTCCGACCAGCTGGTGCTGGAGGTGTCGGTGACG GCTCGGGTGCCCATGCCCTCATGCCTTCGGAGGGGCCAAACATACCTCCTGCCCATCCAGGTCAA CCCTGTCAATGACCCACCCCACATCATCTTCCCACATGGCAGCCTCATGGTGATCCTGGAACACA CGCAGAAGCCGCTGGGGCCTGAGGTTTTCCAGGCCTATGACCCGGACTCTGCCTGTGAGGGCCTC ACCTTCCAGGTCCTTGGCACCTCCTCTGGCCTCCCCGTGGAGCGCCGAGACCAGCCTGGGGAGCC GGCGACCGAGTTCTCCTGCCGGGAGTTGGAGGCCGGCAGCCTAGTCTATGTCCACTGCGGTGGTC CTGCACAGGACTTGACGTTCCGGGTCAGCGATGGACTGCAGGCCCAGCCCCCTGCCACGCTGAAG GTGGTGGCCATCCGGCCGGCCATACAGATCCACAGATCTACAGGGTTGCGACTGGCCAAGGCTC TGCCATGCCCATCTTGCCCGCCAACCTGTCGGTGGAGACCAATGCCGTGGGGCAGGATGTGAGCG TGCTGTTCCGCGTCACTGGGGCCCTGCAGTTTGGGGAGCTGCAGAAGCATAGTACAGGTGGGGTG GAGGGTGCTGAGTGGTGGGCCACACAGGCGTTCCACCAGCGGGATGTGGAGCAGGGCCGCGTGAG GTACCTGAGCACTGACCCACAGCACCACGCTTACGACACCGTGGAGAACCTGGCCCTGGAGGTGC AGGTGGGCCAGGAGATCCTGAGCAATCTGTCCTTCCCAGTGACCATCCAGAGAGCCACTGTGTGG ATGCTGCGGCTGGAGCCACTGCACACTCAGAACACCCAGCAGGAGACCCTCACCACAGCCCACCT GGAGGCCACCCTGGAGGAGGCAGGCCCAAGCCCCCCAACCTTCCATTATGAGGTGGTTCAGGCTC CCAGGAAAGGCAACCTTCAACTACAGGGCACAAGGCTGTCAGATGGCCAGGGCTTCACCCAGGAT GACATACAGGCTGGCCGGGTGACCTATGGGGCCACAGCTCGTGCCTCAGAGGCAGTCGAGGACAC CTTCCGTTTCCGTGTCACGGCGCCACCATATTTCTCCCCACTCTATACCTTCCCCATCCACATTG |

| SEQ ID NO. | DESIGNATION | SOURCE | TYPE | SEQUENCE |
|---|---|---|---|---|
| | | | | GTGGTGACCCAGATGCGCCTGTCCTCACCAATGTCCTCCTCGTGGTGCCTGAGGGTGGTGAGGGT |
| | | | | GTCCTCTCTGCTGACCACCTCTTTGTCAAGAGTCTCAACAGTGCCAGCTACCTCTATGAGGTCAT |
| | | | | GGAGCGGCCCCGCCTTGGGAGGTTGGCTTGGCGTGGGACACAGGACAAGACCACTATGGTGACAT |
| | | | | CCTTCACCAATGAAGACCTGTTGCGTGGCCGGCTGGTCTACCAGCATGATGACTCCGAGACCACA |
| | | | | GAAGATGATATCCCATTTGTTGCTACCCGCCAGGGCGAGAGCAGTGGTGACATGGCCTGGGAGGA |
| | | | | GGTACGGGGTGTCTTCCGAGTGGCCATCCAGCCCGTGAATGACCACGCCCCTGTGCAGACCATCA |
| | | | | GCCGGATCTTCCATGTGGCCCGGGTGGGCGGCGGCTGCTGACTACAGACGACGTGGCCTTCAGC |
| | | | | GATGCTGACTCGGGCTTTGCTGACGCCCAGCTGGTGCTTACCCGCAAGGACCTCCTCTTTGGCAG |
| | | | | TATCGTGGCCGTAGATGAGCCCACGCGGCCCATCTACCGCTTCACCCAGGAGGACCTCAGGAAGA |
| | | | | GGCGAGTACTGTTCGTGCACTCAGGGGCTGACCGTGGCTGGATCCAGCTGCAGGTGTCCGACGGG |
| | | | | CAACACCAGGCCACTGCGCTGCTGGAGGTGCAGGCCTCGGAACCCTACCTCCGTGTGGCCAACGG |
| | | | | CTCCAGCCTTGTGGTCCCTCAAGGAGGCCAGGGCACCATCGACACGGCCGTGCTCCACCTGGACA |
| | | | | CCAACCTCGACATCCGCAGTGGGGATGAGGTCCACTACCACGTCACAGCTGGCCCTCGCTGGGGA |
| | | | | CAACTAGTCCGGGCTGGTCAGCCAGCCACAGCCTTCTCCCAGCAGGACCTGCTGGATGGGGCCGT |
| | | | | TCTCTATAGCCACAATGGCAGCCTCAGCCCCAAGACACCATGGCCTTCTCCGTGGAAGCAGGGC |
| | | | | CAGTGCACACGGATGCCACCCTACAAGTGACCATTGCCCTAGAGGGCCCACTGGCCCCACTGAAG |
| | | | | CTGGTCCGGCACAAGAAGATCTACGTCTTCCAGGGAGAGGCAGCTGAGATCAGAAGGGACCAGCT |
| | | | | GGAGGCAGCCCAGGAGGCAGTGCCACCTGCAGACATCGTATTCTCAGTGAAGAGCCCACCGAGTG |
| | | | | CCGGCTACCTGGTGATGGTGTCGCGTGGCGCCTTGGCAGATGAGCCACCCAGCCTGGACCCTGTG |
| | | | | CAGAGCTTCTCCCAGGAGGCAGTGGACACAGGCAGGGTCCTGTACCTGCACTCTAGACCTGAGGC |
| | | | | CTGGAGCGATGCCTTCTCGCTGGATGTGGCCTCAGGCCTGGGTGCTCCCCTCGAGGGCGTCCTTG |
| | | | | TGGGAGCTGGAGGTGCTGCCGCTGCCATCCCACTAGAGGCGCAAAACTTCAGCGTCCCTGAGGGT |
| | | | | GGCAGCCTCACCCTGGCCCCTCCACTGCTCCGTGTCTCCGGGCCCTACTTCCCACTCTCCTGGG |
| | | | | CCTCAGCCTGCAGGTGCTGGAGCCACCCCAGCATGGACCCCTGCAGAAGGAGGACGGACCTCAAG |
| | | | | CCAGGACCCTCAGCGCCTTCTCCTGGAGAATGGTGGAAGAGCAGCTGATCCGCTACGTGCATGAC |
| | | | | GGGGACGAGACACTGACAGACAGTTTGTCCTGATGGCTAATGCCTCCGAGATGGATCGCCAGAG |
| | | | | CCATCCTGTGGCCTTCACTGTCACTGTCCTGCCTGTCAATGACCAACCCCCCATCCTCACTACAA |
| | | | | ACACAGGCCTGCAGATGTGGGAGGGGCCACTGCGCCCATCCCTGCGGAGGCTCTGAGGAGCACG |
| | | | | GACGGCGACTCTGGGTCTGAGGATCTGGTCTACACCATCGAGCAGCCCAGCAACGGGCGGGTAGT |
| | | | | GCTGCGGGGGCGCCGGGCACTGAGGTGCGCAGCTTCACGCAGGCCCAATTGGACGGCGGGCTCG |
| | | | | TGCTGTTCTCACACAGAGGAACCCTGGATGGAGGCTTCCGCTTCCGCCTCTCTGACGGCGAGCAC |
| | | | | ACTTCCCCCGGACACTTCTTCCGAGTGACGGCCAGAAGCAAGTGCTCCTCTCGCTGAAGGGCAG |
| | | | | CCAGACACTGACTGTCTGCCCAGGGTCCGTCCAGCCACTCAGCAGTCAGACCCTCAGGGCCAGCT |
| | | | | CCAGCGCAGGCACTGACCCCCAGCTCCTGCTCTACCGTGTGGTGCGGGGCCCCCAGCTAGGCCGG |
| | | | | CTGTTCCACGCCCAGCAGGACAGCACAGGGGAGGCCCTGGTGAACTTCACTCAGGCAGAGGTCTA |
| | | | | CGCTGGGAATATTCTGTATGAGCATGAGATGCCCCCGAGCCCTTTTGGGAGGCCCATGATACCC |
| | | | | TAGAGCTCCAGCTGTCCTCGCCGCCTGCCCGGGACGTGGCCGCCACCCTTGCTGTGGCTGTGTCT |
| | | | | TTTGAGGCTGCCTGTCCCCAGCGCCCCAGCCACCTCTGGAAGAACAAAGGTCTCTGGGTCCCCGA |
| | | | | GGGCCAGCGGGCCAGGATCACCGTGGCTGCTCTGGATGCCTCCAATCTCTTGGCCAGCGTTCCAT |
| | | | | CACCCCAGCGCTCAGAGCATGATGTGCTCTTCCAGGTCACACAGTTCCCCAGCCGCGGCCAGCTG |
| | | | | TTGGTGTCCGAGGAGCCCCTCCATGCTGGGCAGCCCCACTTCCTGCAGTCCCAGCTGGCTGCAGG |
| | | | | GCAGCTAGTGTATGCCCACGGCGGTGGGGGCACCCAGCAGGATGGCTTCCACTTTCGTGCCCACC |
| | | | | TCCAGGGGCCAGCAGGGGCCTCCGTGGCTGGACCCCAAACCTCAGAGGCCTTTGCCATCACGGTG |
| | | | | AGGGATGTAAATGAGCGGCCCCCTCAGCCACAGGCCTCTGTCCCACTCCGGCTCACCCGAGGCTC |
| | | | | TCGTGCCCCCATCTCCCGGGCCCAGCTGAGTGTGGTGGACCCAGACTCAGCTCCTGGGGAGATTG |
| | | | | AGTACGAGGTCCAGCGGGCACCCCACAACGGCTTCCTCAGCCTGGTGGGTGGTGGCCTGGGGCCC |
| | | | | GTGACCCGCTTCACGCAAGCCGATGTGGATTCAGGGCGGCTGGCCTTCGTGGCCAACGGGAGCAG |
| | | | | CGTGGCAGGCATCTTCCAGCTGAGCATGTCTGATGGGGCCAGCCCACCCCTGCCCATGTCCCTGG |
| | | | | CTGTGGACATCCTACCATCCGCCATCGAGGTGCAGCTGCGGGCACCCCTGGAGGTGCCCCAAGCT |
| | | | | TTGGGGCGCTCCTCACTGAGCCAGCAGCAGCTCCGGGTGGTTTCAGATCGGGAGGAGCCAGAGGC |
| | | | | AGCATACCGGTTGATCCAGGGACCCCAGTATGGGCATCTCCTGGTGGGCGGGCGGCCCACCTCGG |
| | | | | CCTTCAGCCAATTCCAGATAGACCAGGGCGAGGTGGTCTTTGCCTTCACCAACTCCTCCTCCTCT |
| | | | | CATGACCACTTCAGAGTCCTGGCACTGGCTAGGGTGTCAATGCATCAGCCGTAGTGAACGTCAC |
| | | | | TGTGAGGGCTCTGCTGCATGTGTGGGCAGGTGGGCCATGGCCCCAGGGTGCCACCCTGCGCCTGG |
| | | | | ACCCCACCGTCCTAGATGCTGGCGAGCTGGCCAACCGCACAGACAGTGTGCCGCGCTTCCGCCTC |
| | | | | CTGGAGGGACCCCGGCATGGCCGCGTGGTCCGCGTGCCCCGAGCCAGGACGGAGCCCGGGGCAG |
| | | | | CCAGCTGGTGGAGCAGTTCACTCAGCAGGACCTTGAGGACGGGAGGCTGGGGCTGGAGGTGGCA |
| | | | | GGCCAGAGGGGAGGGCCCCGGCCCCGCAGGTGACAGTCTCACTCTGGAGCTGTGGGCACAGGGC |
| | | | | GTCCGCCTGCTGTGGCCTCCCTGGACTTTGCCACTGAGCCTTACAATGCTGCCGGCCCTACAG |
| | | | | CGTGGCCCTGCTCAGTGTCCCCGAGGCCGCCGGACGGAAGCAGGGAAGCCAGAGAGCAGCACCC |
| | | | | CCACAGGCGAGCCAGGCCCCATGGCATCCAGCCCTGAGCCCGCTGTGGCAAGGGAGGCTTCCTG |
| | | | | AGCTTTCTAGAGGCCAACATGTTCAGCGTCATCATCCCCATGTGCCTGGTACTTCTGCTCCTGGC |
| | | | | GCTCATCCTGCCCCTGCTCTTCTACCTCCGAAAACGCAACAAGACGGGCAAGCATGACGTCCAGG |
| | | | | TCCTGACTGCCAAGCCCCGCAACGGCCTGGCTGGTGACACCAGACCTTTCGCAAGGTGGAGCCA |
| | | | | GGCCAGGCCATCCCGCTCACAGCTGTGCCTGGCCAGGGGCCCCTCCAGGAGGCCAGCCTGACCC |
| | | | | AGAGCTGCTGCAGTTCTGCCGGACACCCAACCCTGCCCTTAAGAATGGCCAGTACTGGGTGTGA |
| 198. | EpCAM-hNG2 | artificial | aa | MGWSCIILFLVATATGVHSTATFAAAQEECVCENYKLAVNCFVNNNRQCQCTSVGAQNTVICSKL |
| | | | | AAKCLVMKAEMNGSKLGRRAKPEGALQNNDGLYDPDCDESGLFKAKQCNGTSTCWCVNTAGVRRT |
| | | | | DKDTEITCSERVRTYWIIIELKHKAREKPYDSKSLRTALQKEITTRYQLDPKFITSILYENNVIT |
| | | | | IDLVQNSSQKTQNDVDIADVAYYFEKDVKGESLFHSKKMDLTVNGEQLDLDPGQTLIYYVDEKAP |
| | | | | EFSMQGLKGVHSDYKDDDDKSVHSASFFGENHLEVPVATALTDIDLQLQFSTSQPEALLLLAAGP |
| | | | | ADHLLLQLYSGRLQVRLVLGQEELRLQTPAETLLSDSIPHTVVLTVVEGWATLSVDGFLNASSAV |
| | | | | PGAPLEVPYGLFVGGTGTLGLPYLRGTSRPLRGCLHAATLNGRSLLRPLTPDVHEGCAEEFSASD |
| | | | | DVALGFSGPHSLAAFPAWGTQDEGTLEFTLTTQSRQAPLAFQAGGRRGDFIYVDIFEGHLRAVVE |

| SEQ ID NO. | DESIGNATION | SOURCE | TYPE | SEQUENCE |
|---|---|---|---|---|
| | | | | KGQGTVLLHNSVPVADGQPHEVSVHINAHRLEISVDQYPHTSNRGVLSYLEPRGSLLLGGLDAE<br>ASRHLQEHRLGLTPEATNASLLGCMEDLSVNGQRRGLREALLTRNMAAGCRLEEEEYEDDAYGHY<br>EAFSTLAPEAWPAMELPEPCVPEPGLPPVFANFTQLLTISPLVVAEGGTAWLEWRHVQPTLDLME<br>AELRKSQVLFSVTRGAHYGELELDILGAQARKMFTLLDVVNRKARFIHDGSEDTSDQLVLEVSVT<br>ARVPMPSCLRRGQTYLLPIQVNPVNDPPHIIFPHGSLMVILEHTQKPLGPEVFQAYDPDSACEGL<br>TFQVLGTSSGLPVERRDQPGEPATEFSCRELEAGSLVYVHCGGPAQDLTFRVSDGLQASPPATLK<br>VVAIRPAIQIHRSTGLRLAQGSAMPILPANLSVETNAVGQDVSVLFRVTGALQFGELQKHSTGGV<br>EGAEWWATQAFHQRDVEQGRVRYLSTDPQHHAYDTVENLALEVQVGQEILSNLSFPVTIQRATVW<br>MLRLEPLHTQNTQQETLTTAHLEATLEEAGPSPPTFHYEVVQAPRKGNLQLQGTRLSDGQGFTQD<br>DIQAGRVTYGATARASEAVEDTFRFRVTAPPYFSPLYTFPIHIGGDPDAPVLTNVLLVVPEGGEG<br>VLSADHLFVKSLNSASYLYEVMERPRLGRLAWRGTQDKTTMVTSFTNEDLLRGRLVYQHDDSETT<br>EDDIPFVATRQGESSGDMAWEEVRGVFRVAIQPVNDHAPVQTISRIFHVARGGRRLLTTDDVAFS<br>DADSGFADAQLVLTRKDLLFGSIVAVDEPTRPIYRFTQEDLRKRRVLFVHSGADRGWIQLQVSDG<br>QHQATALLEVQASEPYLRVANGSSLVVPQGGQGTIDTAVLHLDTNLDIRSGDEVHYHVTAGPRWG<br>QLVRAGQPATAFSQQDLLDGAVLYSHNGSLSPEDTMAFSVEAGPVHTDATLQVTIALEGPLAPLK<br>LVRHKKIYVFQGEAAEIRRDQLEAAQEAVPPADIVFSVKSPPSAGYLVMVSRGALADEPPSLDPV<br>QSFSQEAVDTGRVLYLHSRPEAWSDAFSLDVASGLGAPLEGVLVELEVLPAAIPLEAQNFSVPEG<br>GSLTLAPPLLRVSGPYFPTLLGLSLQVLEPPQHGPLQKEDGPQARTLSAFSWRMVEEQLIRYVHD<br>GSETLTDSFVLMANASEMDRQSHPVAFTVTVLPVNDQPPILTTNTGLQMWEGATAPIPAEALRST<br>DGDSGGEDLVYTIEQPSNGRVVLRGAPGTEVRSFTQAQLDGGLVLFSHRGTLDGGFRFRLSDGEH<br>TSPGHFFRVTAQKQVLLSLKGSQTLTVCPGSVQPLSSQTLRASSSAGTDPQLLLYRVVRGPQLGR<br>LFHAQQDSTGEALVNFTQAEVYAGNILYEHEMPPEPFWEAHDTLELQLSSPPARDVAATLAVAVS<br>FEAACPQRPSHLWKNKGLWVPEGQRARITVAALDASNLLASVPSPQRSEHDVLFQVTQFPSRGQL<br>LVSEEPLHAGQPHFLQSQLAAGQLVYAHGGGGTQQDGFHFRAHLQGPAGASVAGPQTSEAFAITV<br>RDVNERPPQPQASVPLRLTRGSRAPISRAQLSVVDPDSAPGEIEYEVQRAPHNGFLSLVGGGLGP<br>VTRFTQADVDSGRLAFVANGSSVAGIFQLSMSDGASPPLPMSLAVDILPSAIEVQLRAPLEVPQA<br>LGRSSLSQQQLRVVSDREEPEAAYRLIQGPQYGHLLVGGRPTSAFSQFQIDQGEVVFAFTNSSSS<br>HDHFRVLALARGVNASAVVNVTVRALLHVWAGGPWPQGATLRLDPTVLDAGELANRTDSVPRFRL<br>LEGPRHGRVVRVPRARTEPGGSQLVEQFTQQDLEDGRLGLEVGRPEGRAPGPAGDSLTLELWAQG<br>VPPAVASLDFATEPYNAARPYSVALLSVPEAARTEAGKPESSTPTGEPGPMASSPEPAVAKGGFL<br>SFLEANMFSVIIPMCLVLLLLALILPLLFYLRKRNKTGKHDVQVLTAKPRNGLAGDTETFRKVEP<br>GQAIPLTAVPGQGPPPGGQPDPELLQFCRTPNPALKNGQYWV |
| 199. | 5-10 x I2C | artificial | nt | GAGCTCGTGATGACACAGTCTCCATCCTCCCTGACTGTGACAGCAGGAGAGAAGGTCACTATGAG<br>CTGCAAGTCCAGTCAGAGTCTGTTAAACAGTGGAAATCAAAAGAACTACTTGACCTGGTACCAGC<br>AGAAACCAGGGCAGCCTCCTAAACTGTTGATCTACTGGGCATCCACTAGGGAATCTGGGGTCCCT<br>GATCGCTTCACAGGCAGTGGATCTGGAACAGATTTCACTCTCACCATCAGCAGTGTGCAGGCTGA<br>AGACCTGGCAGTTTATTACTGTCAGAATGATTATAGTTATCCGCTCACGTTCGGTGCTGGGACCA<br>AGCTTGAGATCAAAGGTGGTGGTGGTTCTGGCGGCGGCGGCTCCGGTGGTGGTGGTTCTGAGGTG<br>CAGCTGCTCGAGCAGTCTGGAGCTGAGCTGGTAAGGCCTGGGACTTCAGTGAAGATATCCTGCAA<br>GGCTTCTGGATACGCCTTCACTAACTACTGGCTAGGTTGGGTAAAGCAGAGGCCTGGACATGGAC<br>TTGAGTGGATTGGAGATATTTTTCCCTGGAAGTGGTAATATCCACTACAATGAAGTTCAAGGGC<br>AAAGCCACACTGACTGCAGACAAATCTTCGAGCACAGCCTATATGCAGCTCAGTAGCCTGACATT<br>TGAGGACTCTGCTGTCTATTTCTGTGCAAGACTGAGGAACTGGGACGAGCCTATGGACTACTGGG<br>GCCAAGGGACCACGGTCACCGTCTCCTCGGAGGTGGTGGATCCGAGGTGCAGCTGGTCGAGTCT<br>GGAGGAGGATTGGTGCAGCCTGGAGGGTCATTGAAACTCTCATGTGCAGCCTCTGGATTCACCTT<br>CAATAAGTACGCCATGAACTGGGTCCGCCAGGCTCCAGGAAAGGGTTTGGAATGGGTTGCTCGCA<br>TAAGAAGTAAATATAATAATTATGCAACATATTATGCCGATTCAGTGAAAGACAGGTTCACCATC<br>TCCAGAGATGATTCAAAAACACTGCCTATCTACAAATGAACAACTTGAAACTGAGGACACTGCC<br>CGTGTACTACTGTGTGAGACATGGGAACTTCGGTAATAGCTACATATCCTACTGGGCTTACTGGG<br>GCCAAGGGACTCTGGTCACCGTCTCCTCAGGTGGTGGTGGTTCTGGCGGCGGCTCCGGTGGT<br>GGTGGTTCTCAGACTGTTGTGACTCAGGAACCTTCACTCACCGTATCACCTGGTGGAACAGTCAC<br>ACTCACTTGTGGCTCCTCGACTGGGGCTGTTACATCTGGCAACTACCCAAACTGGGTCCAACAAA<br>AACCAGGTCAGGCACCCCGTGGTCTAATAGGTGGGACTAAGTTCCTCGCCCCCGGTACTCCTGCC<br>AGATTCTCAGGCTCCCTGCTTGGAGGCAAGGCTGCCCTCACCCTCTCAGGGGTACAGCCAGAGGA<br>TGAGGCAGAATATTACTGTGTTCTATGGTACAGCAACCGCTGGGTGTTCGGTGGAGGAACCAAAC<br>TGACTGTCCTA |
| 200. | 5-10 x I2C | artificial | aa | ELVMTQSPSSLTVTAGEKVTMSCKSSQSLLNSGNQKNYLTWYQQKPGQPPKLLIYWASTRESGVP<br>DRFTGSGSGTDFTLTISSVQAEDLAVYYCQNDYSYPLTFGAGTKLEIKGGGGSGGGGSGGGGSEV<br>QLLEQSGAELVRPGTSVKISCKASGYAFTNYWLGWVKQRPGHGLEWIGDIFPGSGNIHYNEKFKG<br>KATLTADKSSSTAYMQLSSLTFEDSAVYFCARLRNWDEPMDYWGQGTTVTVSSGGGGSEVQLVES<br>GGGLVQPGGSLKLSCAASGFTFNKYAMNWVRQAPGKGLEWVARIRSKYNNYATYYADSVKDRFTI<br>SRDDSKNTAYLQMNNLKTEDTAVYYCVRHGNFGNSYISYWAYWGQGTLVTVSSGGGGSGGGGSGG<br>GGSQTVVTQEPSLTVSPGGTVTLTCGSSTGAVTSGNYPNWVQQKPGQAPRGLIGGTKFLAPGTPA<br>RFSGSLLGGKAALTLSGVQPEDEAEYYCVLWYSNRWVFGGGTKLTVL |
| 201. | human PSMA construct | artificial | nt | ATGTGGAATCTCCTTCACGAAACCGACTCGGCTGTGGCCACCGCGCGCCGCCCGCGCTGGCTGTG<br>CGCTGGGGCGCTGGTGCTGGCGGGTGGCTTCTTTCTCCTCGGCTTCCTCTTCGGGTGGTTTATAA<br>AATCCTCCAATGAAGCTACTAACATTACTCCAAAGCATAATATGAAAGCATTTTTGGATGAATTG<br>AAAGCTGAGAACATCAAGAAGTTCTTATATAATTTTACACAGATACCACATTTAGCAGGAACAGA<br>ACAAAACTTTCAGCTTGCAAAGCAAATTCAATCCCAGTGGAAAGAATTTGGCCTGGATTCTGTTG<br>AGCTAGCACATTATGATGTCCTGTTGTCCTACCCAAATAAGACTCATCCCAACTACATCTCAATA<br>ATTAATGAAGATGGAAATGAGATTTTCAACACATCATTATTTGAACCACCTCCTCCAGGATATGA<br>AAATGTTTCGGATATTGTACCACCTTTCAGTGCTTTCTCTCCTCAAGGAATGCCAGAGGGCGATC |

| SEQ ID NO. | DESIGNATION | SOURCE | TYPE | SEQUENCE |
|---|---|---|---|---|
| | | | | TAGTGTATGTTAACTATGCACGAACTGAAGACTTCTTTAAATTGGAACGGGACATGAAAATCAAT
TGCTCTGGGAAAATTGTAATTGCCAGATATGGGAAAGTTTTCAGAGGAAATAAGGTTAAAAATGC
CCAGCTGGCAGGGGCCAAAGGAGTCATTCTCTACTCCGACCCTGCTGACTACTTTGCTCCTGGGG
TGAAGTCCTATCCAGATGGTTGGAATCTTCCTGGAGGTGGTGTCCAGCGTGGAAATATCCTAAAT
CTGAATGGTGCAGGAGACCCTCTCACACCAGGTTACCCAGCAAATGAATATGCTTATAGGCGTGG
AATTGCAGAGGCTGTTGGTCTTCCAAGTATTCCTGTTCATCCAATTGGATACTATGATGCACAGA
AGCTCCTAGAAAAAATGGGTGGCTCAGCACCACCAGATAGCAGCTGGAGAGGAAGTCTCAAAGTG
CCCTACAATGTTGGACCTGGCTTTACTGGAAACTTTTCTACACAAAAAGTCAAGATGCACATCCA
CTCTACCAATGAAGTGACAAGAATTTACAATGTGATAGGTACTCTCAGAGGAGCAGTGGAACCAG
ACAGATATGTCATTCTGGGAGGTCACCGGGACTCATGGGTGTTTGGTGGTATTGACCCTCAGAGT
GGAGCAGCTGTTGTTCATGAAATTGTGAGGAGCTTTGGAACACTGAAAAAGGAAGGGTGGAGACC
TAGAAGAACAATTTTGTTTGCAAGCTGGGATGCAGAAGAATTTGGTCTTCTTGGTTCTACTGAGT
GGGCAGAGGAGAATTCAAGACTCCTTCAAGAGCGTGGCGTGGCTTATATTAATGCTGACTCATCT
ATAGAAGGAAACTACACTCTGAGAGTTGATTGTACACCGCTGATGTACAGCTTGGTACACAACCT
AACAAAAGAGCTGAAAAGCCCTGATGAAGGCTTTGAAGGCAAATCTCTTTATGAAAGTTGGACTA
AAAAAAGTCCTTCCCCAGAGTTCAGTGGCATGCCCAGGATAAGCAAATTGGGATCTGGAAATGAT
TTTGAGGTGTTCTTCCAACGACTTGGAATTGCTTCAGGCAGAGCACGGTATACTAAAAATTGGGA
AACAAACAAATTCAGCGGCTATCCACTGTATCACAGTGTCTATGAAACATATGAGTTGGTGGAAA
AGTTTTATGATCCAATGTTTAAATATCACCTCACTGTGGCCCAGGTTCGAGGAGGGATGGTGTTT
GAGCTAGCCAATTCCATAGTGCTCCCTTTTGATTGTGAGATTATGCTGTAGTTTTAAGAAAGTA
TGCTGACAAAATCTACAGTATTTCTATGAAACATCCACAGGAAATGAAGACATACAGTGTATCAT
TTGATTCACTTTTTTCTGCAGTAAAGAATTTTACAGAAATTGCTTCCAAGTTCAGTGAGAGACTC
CAGGACTTTGACAAAAGCAACCCAATAGTATTAAGAATGATGAATGATCAACTCATGTTTCTGGA
AAGAGCATTTATTGATCCATTAGGGTTACCAGACAGGCCTTTTTATAGGCATGTCATCTATGCTC
CAAGCAGCCACAACAAGTATGCAGGGGAGTCATTCCCAGGAATTTATGATGCTCTGTTTGATATT
GAAAGCAAAGTGGACCCTTCCAAGGCCTGGGGAGAAGTGAAGAGACAGATTTATGTTGCAGCCTT
CACAGTGCAGGCAGCTGCAGAGACTTTGAGTGAAGTAGCCTAA |
| 202. | human PSMA construct | artificial | aa | MWNLLHETDSAVATARRPRWLCAGALVLAGGFFLLGFLFGWFIKSSNEATNITPKHNMKAFLDEL
KAENIKKFLYNFTQIPHLAGTEQNFQLAKQIQSQWKEFGLDSVELAHYDVLLSYPNKTHPNYISI
INEDGNEIFNTSLFEPPPPGYENVSDIVPPFSAFSPQGMPEGDLVYVNYARTEDFFKLERDMKIN
CSGKIVIARYGKVFRGNKVKNAQLAGAKGVILYSDPADYFAPGVKSYPDGWNLPGGGVQRGNILN
LNGAGDPLTPGYPANEYAYRRGIAEAVGLPSIPVHPIGYYDAQKLLEKMGGSAPPDSSWRGSLKV
PYNVGPGFTGNFSTQKVKMHIHSTNEVTRIYNVIGTLRGAVEPDRYVILGGHRDSWVFGGIDPQS
GAAVVHEIVRSFGTLKKEGWRPRRTILFASWDAEEFGLLGSTEWAEENSRLLQERGVAYINADSS
IEGNYTLRVDCTPLMYSLVHNLTKELKSPDEGFEGKSLYESWTKKSPSPEFSGMPRISKLGSGND
FEVFFQRLGIASGRARYTKNWETNKFSGYPLYHSVYETYELVEKFYDPMFKYHLTVAQVRGGMVF
ELANSIVLPFDCRDYAVVLRKYADKIYSISMKHPQEMKTYSVSFDSLFSAVKNFTEIASKFSERL
QDFDKSNPIVLRMMNDQLMFLERAPIDPLGLPDRPFYRHVIYAPSSHNKYAGESFPGIYDALFDI
ESKVDPSKAWGEVKRQIYVAAFTVQAAAETLSEVA |
| 203. | soluble fusion protein of h PSMA and m Lag3 | artificial | nt | ATGAGGGAGGACCTGCTCCTTGGCTTTTTGCTTCTGGGACTGCTTTGGGAAGCTCCAGTTGTGTC
TTCAGGGCCTGGGAAAGAGCTCCCCGTGGTGTGGGCCCAGGAGGGAGCTCCCGTCCATCTTCCCT
GCAGCCTCAAATCCCCCAACCTGGATCCTAACTTTCTACGAAGAGGAGGGGTTATCTGGCAACAT
CAACCAGACAGTGGCCAACCCACTCCCATCCCGGCCTTGACCTTCACCAGGGGATGCCCTCGCC
TAGACAACCCGCACCCGGTCGCTACACGGTGCTGAGCGTGGCTCCAGGAGGCCTGCGCAGCGGGA
GGCAGCCCCTGCATCCCCACGTGCAGCTGGAGGAGCGCGGCCTCCAGCACGGCGGGGACTTCTCT
GGTTGCGCCCAGCTCTGCGCACCGATGCGGGCGAGTACCACGCCACCGTGCGCCTCCCGAACCG
CGCCCTCTCCTGCAGTCTCCGCCTGCGCGTCGGCCAGGCCTCGATGATTGCTAGTCCCTCAGGAG
TCCTCAAGCTGTCTGATTGGGTCCTTTTGAACTGCTCCTTCAGCCGTCCTGACCGCCCAGTCTCT
GTGCACTGGTTCCAGGGCCAGAACCGAGTGCCTGTCTACAACTCACCGCGTCATTTTTTAGCTGA
AACTTTCCTGTTACTGCCCCAAGTCAGCCCCCTGGACTCTGGGACCTGGGGCTGTGTCCTCACCT
ACAGAGATGGCTTCAATGTCTCCATCACGTACAACCTCAAGGTTCTGGGTCTGGAGCCCGTAGCC
CCTCTGACAGTGTACGCTGCTGAAGGTTCTAGGGTGGAGCTGCCCTGTCATTTGCCCCAGGAGT
GGGGACCCCTTCTTTGCTCATTGCCAAGTGGACTCCTCCTTGGAGGAGGGTCCTGAGCTCCCCGTGG
CTGGAAAGAGTGGCAATTTTACCCTTCACCTTGAGGCTGTGGGTCTGGCACAGGCTGGGACCTAC
ACCTGTAGCATCCATCTGCAGGGACAGCAGCTCAATGCCACTGTCACGTTGGCCGTCATCACAGT
GACTCCCAATCCTTCGGGTTACCTGGCTCCGGGGGAAGCTGTTGTGAGGTAACCCCGGCAT
CTGGAAAGGAAAGATTTGTGTGGCGTCCCCTGAACAATCTGTCCAGGAGTTGCCCGGGCCTGTG
CTGGAGATTCAGGAGGCCAGGCTCCTTGCTGAGCGATGGCAGTGTCAGCTGTACGAGGGCCAGAG
GCTTCTTGGAGCGACAGTGTACGCCGCAGAGTTAGCTCAGGCGCCCACAGTGCTAGGAGAATCT
CAGGTGACCTTAAAGGAGGCCATTCCGGAGGTGGTGGATCCAAATCCTCCAATGAAGCTACTAAC
ATTACTCCAAAGCATAATATGAAAGCATTTTTGGATGAATTGAAAGCTGAGAACATCAAGAAGTT
CTTATATAATTTTACACAGATACCACATTTAGCAGGAACAGAACAAAACTTTCAGCTTGCAAAGC
AAATTCAATCCCAGTGGAAAGAATTTGGCCTGGATTCTGTTGAGCTAGCACATTATGATGTCCTG
TTGTCCTACCCAAATAAGACTCATCCCAACTACATCTCAATAATTAATGAAGATGGAAATGAGAT
TTTCAACACATCATTATTTGAACCACCTCCTCCAGGATATGAAAATGTTTCGGATATTGTACCAC
CTTTCAGTGCTTTCTCTCCTCAAGGAATGCCAGAGGGCGATCTAGTGTATGTTAACTATGCACGA
ACTGAAGACTTCTTTAAATTGGAACGGGACATGAAAATCAATTGCTCTGGGAAAATTGTAATTGC
CAGATATGGGAAAGTTTTCAGAGGAAATAAGGTTAAAAATGCCCAGCTGGCAGGGGCCAAAGGAG
TCATTCTCTACTCCGACCCTGCTGACTACTTTGCTCCTGGGGTGAAGTCCTATCCAGATGGTTGG
AATCTTCCTGGAGGTGGTGTCCAGCGTGGAAATATCCTAAATCTGAATGGTGCAGGAGACCCTCT
CACACCAGGTTACCCAGCAAATGAATATGCTTATAGGCGTGGAATTGCAGAGGCTGTTGGTCTTC
CAAGTATTCCTGTTCATCCAATTGGATACTATGATGCACAGAAGCTCCTAGAAAAAATGGGTGGC
TCAGCACCACCAGATAGCAGCTGGAGAGGAAGTCTCAAAGTGCCCTACAATGTTGGACCTGGCTT |

| SEQ ID NO. | DESIGNATION | SOURCE | TYPE | SEQUENCE |
|---|---|---|---|---|
| | | | | TACTGGAAACTTTTCTACACAAAAAGTCAAGATGCACATCCACTCTACCAATGAAGTGACAAGAA<br>TTTACAATGTGATAGGTACTCTCAGAGGAGCAGTGGAACCAGACAGATATGTCATTCTGGGAGGT<br>CACCGGGACTCATGGGTGTTTGGTGGTATTGACCCTCAGAGTGGAGCAGCTGTTGTTCATGAAAT<br>TGTGAGGAGCTTTGGAACACTGAAAAAGGAAGGGTGGAGACCTAGAAGAACAATTTTGTTTGCAA<br>GCTGGGATGCAGAAGAATTTGGTCTTCTTGGTTCTACTGAGTGGGCAGAGGAGAATTCAAGACTC<br>CTTCAAGAGCGTGGCGTGGCCTTATATTAATGCTGACTCATCTATAGAAGGAAACTACACTCTGAG<br>AGTTGATTGTACACCGCTGATGTACAGCTTGGTACACAACCTAACAAAAGAGCTGAAAAGCCCTG<br>ATGAAGGCTTTGAAGGCAAATCTCTTTATGAAAGTTGGACTAAAAAAGTCCTTCCCCAGAGTTC<br>AGTGGCATGCCCAGGATAAGCAAATTGGGATCTGGAAATGATTTTGAGGTGTTCTTCCAACGACT<br>TGGAATTGCTTCAGGCAGAGCACGGTATACTAAAAATTGGGAAACAAACAAATTCAGCGGCTATC<br>CACTGTATCACAGTGTCTATGAAACATATGAGTTGGTGGAAAAGTTTTATGATCCAATGTTTAAA<br>TATCACCTCACTGTGGCCCAGGTTCGAGGAGGGATGGTGTTTGAGCTAGCCAATTCCATAGTGCT<br>CCCTTTTGATTGTCGAGATTATGCTGTAGTTTTAAGAAAGTATGCTGACAAAATCTACAGTATTT<br>CTATGAAACATCCACAGGAAATGAAGACATACAGTGTATCATTTGATTCACTTTTTTCTGCAGTA<br>AAGAATTTTACAGAAATTGCTTCCAAGTTCAGTGAGAGACTCCAGGACTTTGACAAAAGCAACCC<br>AATAGTATTAAGAATGATGAATGATCAACTCATGTTTCTGGAAAGAGCATTTATTGATCCATTAG<br>GGTTACCAGACAGGCCTTTTTATAGGCATGTCATCTATGCTCCAAGCAGCCACAACAAGTATGCA<br>GGGGAGTCATTCCCAGGAATTTATGATGCTCTGTTTGATATTGAAAGCAAAGTGGACCCTTCCAA<br>GGCCTGGGGAGAAGTGAAGAGACAGATTTATGTTGCAGCCTTCACAGTGCAGGCAGCTGCAGAGA<br>CTTTGAGTGAAGTAGCCTCCGGGCATCATCACCATCATCATTGA |
| 204. | soluble fusion protein of h PSMA and m Lag3 | artificial | aa | MREDLLLGFLLLGLLWEAPVVSSGPGKELPVVWAQEGAPVHLPCSLKSPNLDPNFLRRGGVIWQH<br>QPDSGQPTPIPALDLHQGMPSPROPAPGRYTVLSVAPGGLRSGRQPLHPHVQLEERGLQRGDFSL<br>WLRPALRTDAGEYHATVRLPNRALSCSLRLRVGQASMIASPSGVLKLSDWVLLNCSFSRPDRPVS<br>VHWFQGQNRVPVYNSPRHFLAETFLLLPQVSPLDSGTWGCVLTYRDGFNVSITYNLKVLGLEPVA<br>PLTVYAAEGSRVELPCHLPPGVGTPSLLIAKWTPPGGGPELPVAGKSGNFTLHLEAVGLAQAGTY<br>TCSIHLQGQQLNATVTLAVITVTPKSFGLPGSRGKLLCEVTPASGKERFVWRPLNNLSRSCPGPV<br>LEIQEARLLAERWQCQLYEGQRLLGATVYAAESSSSGAHSARRISGDLKGGHSGGGGSKSSNEATN<br>ITPKHNMKAFLDELKAENIKKFLYNFTQIPHLAGTEQNFQLAKQIQSQWKEFGLDSVELAHYDVL<br>LSYPNKTHPNYISIINEDGNEIFNTSLFEPPPPGYENVSDIVPPFSAFSPQGMPEGDLVYVNYAR<br>TEDFFKLERDMKINCSGKIVIARYGKVFRGNKVKNAQLAGAKGVILYSDPADYFAPGVKSYPDGW<br>NLPGGGVQRGNILNLNGAGDPLTPGYPANEYAYRRGIAEAVGLPSIPVHPIGYYDAQKLLEKMGG<br>SAPPDSSWRGSLKVPYNVGPGFTGNFSTQKVKMHIHSTNEVTRIYNVIGTLRGAVEPDRYVILGG<br>HRDSWVFGGIDPQSGAAVVHEIVRSFGTLKKEGWRPRRTILFASWDAEEFGLLGSTEWAEENSRL<br>LQERGVAYINADSSIEGNYTLRVDCTPLMYSLVHNLTKELKSPDEGFEGKSLYESWTKKSPSPEF<br>SGMPRISKLGSGNDFEVFFQRLGIASGRARYTKNWETNKFSGYPLYHSVYETYELVEKFYDPMFK<br>YHLTVAQVRGGMVFELANSIVLPFDCRDYAVVLRKYADKIYSISMKHPQEMKTYSVSFDSLFSAV<br>KNFTEIASKFSERLQDFDKSNPIVLRMMNDQLMFLERAFIDPLGLPDRPFYRHVIYAPSSHNKYA<br>GESFPGIYDALFDIESKVDPSKAWGEVKRQIYVAAFTVQAAAETLSEVASGHHHHHH |
| 205. | rat PSMA construct | artificial | nt | ATGTGGAACGCTCAGCAGGACAGCGACTCCGCGGAGGCCCTGGGACGCCGCCAACGCTGGTTCTG<br>TGCTGGAACACTGGTGCTGGCTTTCACTGGAACCTTCATCATTGGCTTCCTCTTTGGGTGGTTTA<br>TAAAACCCTCCAATGATTCTACTAGCAGTGTTTCCTATCCTGGCATGAAGAAGGCATTTTTGCAA<br>GAATTGAAGGCTGAGAACATCAAAAAATTTTTATACAATTTCACACGGACACCACATTTGGCAGG<br>GACACAACACAATTTTGAGCTTGCAAAGCAAATTCATGCCCAGTGGAAAGAATTTGGCCTGGATT<br>TGGTTGAGTTATCTGATTATGATGTCCTGTTGTCCTACCCAAATAAGACCCATCCCAACTATATC<br>TCAATAATTAATGAAGATGGAAATGAGATTTTCAAAACATCATTAGCTGAACTGTCACCCCCGGG<br>ATATGAGAACATATCAGATGTAGTGCCACCATACAGTGCCTTCTCTCCACAAGGGACACCAGAGG<br>GGGATCTAGTATATGTTAACTATGCACGAACTGAAGACTTCTTTAAACTGGAACGGGTCATGAAG<br>ATCAATTGTTCTGGGAAGATTGTCATCGCCAGATATGGGCAAGTGTTCAGAGGAAATAAGGTTAA<br>AAATGCTCAGCTGGCAGGTGCAAAAGGAATCATTCTGTACTCAGACCCTGCTGATTACTTTGTTC<br>CTGGGGTGAAGTCCTATCCAGATGGTTGGAACCTCCCTGGAGGTGGTGTTCAGCGTGGAAATGTC<br>TTAAATCTTAATGGTGCAGGTGATCCCCTCACACCAGGTTATCCAGCAAATGAATATGCCTACAG<br>GCATGAGTTCACAGAAGCTGTCGGTCTTCCAAGTATTCCTGTCCATCCAATTGGATATGATGATG<br>CACAGAAACTATTAGAACATATGGGTGGCTCCGCACCCCCTGACAGCAGCTGGAAGGGAGGACTA<br>AAAGTGCCTTACAACGTGGGACCTGGCTTTGCTGGAAACTTTTCAAACAAAAGGTCAAGCTGCA<br>TATTCACTCCTACAATAAAGTGACAAGAATCTACAATGTTATTGGTACCCTCAAAGGAGCTGTGG<br>AACCAGACAGATATGTTATTCTTGGAGGGCACAGAGATGCTTGGGTGTTTGGTGGCATTGACCCT<br>CAGAGTGGAGCAGCTGTTGTTCATGAAATTGTCAGGACCTTTGGAACTCTGAAGAAGAAGGTTG<br>GAGGGCCTAGAAGAACTATTTGTTTGCAAGCTGGGATGCTGAAGAATTTGGCCTTCTTGGTTCTA<br>CTGAGTGGGCAGAGGAACATTCAAGACTCTTACAAGAACGTGGTGTGGCTTATATCAACGCTGAT<br>TCTTCCATAGAAGGAAACTACACTCTCAGAGTTGATTGCACACCACTGATGCACAGCTTAGTATA<br>CAACCTAACAAAAGAGCTGCCAAGCCCGGATGAAGGCTTTGAAGGCAAATCTCTTTATGAGAGCT<br>GGAAAGAAAAAGTCCTTCAACTGAGTTCATTGGAATGCCAAGGATTAGCAAGCTGGGGTCTGGC<br>AATGATTTTGAAGTGTTTTTCCAAAGACTTGGAATTGCTTCAGGCAGAGCCCGGTATACTAAAAA<br>TTGGAAAAACAACAAAGTCAGCAGCTATCCTCTCTATCACAGTGTCTATGAAACATACGAATTGG<br>TAGAAAAATTCTATGATCCGACATTTAAATATCACCTCACTGTGGCCCAGGTTCGAGGAGCAATG<br>GTATTTGAATTGGCCAATTCTATAGTGCTTCCCTTTGACTGCCAAAGTTATGCTGTAGCTCTGAA<br>GAAACATGCTGAGACTATCTACAACATTTCAATGAATCATCCACAGGAGATGAAGGCGTACATGA<br>TATCATTTGATTCGCTGTTTTCTGCAGTAAATAATTTTACAGATGTTGCATCCAAGTTCAATCAG<br>AGACTGCAAGACTTAGACAAGAGCAACCCCATATTACTGAGAATTTTGAATGATCAGCTAATGTA<br>TCTGGAACGTGCATTCATTGATCCTTTAGGATTACCAGGAAGGCCTTTCTACAGGCATATCATCT<br>ATGCTCCAAGCAGCCACAACAAGTATGCAGGAGAATCATTCCCAGGGATTTATGATGCCCTTTTT<br>GATATTAATAACAAAGTCGATACTTCTAAGGCCTGGAGAGAAGTGAAGAGACAGATTTCTATTGC |

| SEQ ID NO. | DESIGNATION | SOURCE | TYPE | SEQUENCE |
|---|---|---|---|---|
| | | | | AGCCTTCACAGTGCAAGCTGCAGCAGAGACTCTGAGAGAAGTAGACTCCGGGGATTACAAGGACG ACGATGACAAGTAG |
| 206. | rat PSMA construct | artificial | aa | MWNAQQDSDSAEALGRRQRWFCAGTLVLAFTGTFIIGFLFGWFIKPSNDSTSSVSYPGMKKAFLQ ELKAENIKKFLYNFTRTPHLAGTQHNFELAKQIHAQWKEFGLDLVELSDYDVLLSYPNKTHPNYI SIINEDGNEIFKTSLAELSPPGYENISDVVPPYSAFSPQGTPEGDLVYVNYARTEDFFKLERVMK INCSGKIVIARYGQVFRGNKVKNAQLAGAKGIILYSDPADYFVPGVKSYPDGWNLPGGGVQRGNV LNLNGAGDPLTPGYPANEYAYRHEFTEAVGLPSIPVHPIGYDDAQKLLEHMGGSAPPDSSWKGGL KVPYNVGPGFAGNFSKQKVKLHIHSYNKVTRIYNVIGTLKGAVEPDRYVILGGHRDAWVFGGIDP QSGAAVVHEIVRTFGTLKKKGWRPRRTILFASWDAEEFGLLGSTEWAEEHSRLLQERGVAYINAD SSIEGNYTLRVDCTPLMHSLVYNLTKELPSPDEGFEGKSLYDSWKEKSPSTEFIGMPRISKLGSG NDFEVFFQRLGIASGRARYTKNWKNNKVSSYPLYHSVYETYELVEKFYDPTFKYHLTVAQVRGAM VFELANSIVLPFDCQSYAVALKKHAETIYNISMNHPQEMKAYMISFDSLFSAVNNFTDVASKFNQ RLQDLDKSNPILLRILNDQLMYLERAFIDPLGLPGRPFYRHIYAPSSHNKYAGESFPGIYDALF DINNKVDTSKAWREVKRQISIAAFTVQAAAETLREVDSGDYKDDDDK |
| 207. | mutated human PSMA antigen | artificial | nt | ATGTGGAATCTCCTGCACGAAACCGACTCGGCTGTGGCCACCGCGCGCGCCCGCGCTGGCTGTG CGCTGGGGCGCTGGTGCTGGCGGGTGGCTTCTTTCTCCTCGGCTTCCTCTTCGGGTGGTTTATAA AATCCTCCAATGAAGCTACTAACATTACTCCAAAGCATAATATGAAAGCATTTTTGGATGAATTG AAAGCTGAGAACATCAAGAAGTTCTTATATAATTTTACACAGATACCACATTTAGCAGGAACAGA ACAAAACTTTCAGCTTGCAAAGCAAATTCAATCCCAGTGGAAAGAATTTGGCCTGGATTCTGTTG AGCTAGCACATTATGATGTCCTGTTGTCCTACCCAAATAAGACTCATCCCAACTACATCTCAATA ATTAATGAAGATGGAAATGAGATTTTCAAACATCATTATTTGAACCACCCCCTCCAGGATATGA AAATGTTTCGGATATTGTACCACCTTTCAGTGCTTTCTCTCCTCAAGGAACACCAGAGGGCGATC TAGTGTATGTTAACTATGCACGAACTGAAGACTTCTTTAAATTGGAACGGGTCATGAAAATCAAT TGCTCTGGGAAATTGTAATTGCCAGATATGGGAAAGTTTTCAGAGGGAAATAAGGTTAAAAATGC CCAGCTGGCAGGGGCCAAAGGAGTCATTCTCTACTCCGACCCTGCTGACTACTTTGCTCCTGGGG TGAAGTCCTATCCAGATGGTTGGAATCTTCCTGGAGGTGGTGTCCAGCGTGGAAATATCCTAAAT CTGAATGGTGCAGGAGACCCTCTCACACCAGGTTACCCAGCAAATGAATATGCTTATAGGCGTGG AATTGCAGAGGCTGTTGGTCTTCCAAGTATTCCTGTTCATCCAATTGGATACTATGATGCACAGA AGCTCCTAGAACATATGGGTGGCTCAGCACCACCAGATAGCAGCTGGAGAGGAAGTCTCAAAGTG CCCTACAATGTTGGACCTGGCTTTGCTGGAAACTTTTCTAAACAAAAAGTCAAGCTGCACATCCA CTCTAACCAATGAAGTCGACAAGAATTTACAATGTGATAGGTACTCTCAGAGGAGCAGTGGAACCAG ACAGATATGTCATTCTGGGAGGTCACCGGGACTGGGTGTTTGGTGGTATTGACCCTCAGAGT GGAGCAGCTGTTGTCCATGAATTGTGAGGAGCTTTGGAACACTGAAAAAGGAAGGGTGGAGACC TAGAAGAACAATTTTGTTGCAAGCTGGGATGCAGAAGAATTTGGTCTTCTTGGTTCTACTGAGT GGGCAGAGGAGAATTCAAGACTCCTTCAAGAGCGTGGCGTGGCTTATATTAATGCAGACTCATCT ATAGAAGGGAAACTACACTCTGAGAGTTGATTGTACACCGCTGATGTACAGCTTGGTACACAACCT AACAAAAGAGCTGAAAAGCCCTGATGAAGGCTTTGAAGGCAAATCTCTTTATGAAAGTTGGACTA AAAAAGTCCTTCCCCAGAGTTCAGTGGCATGCCCAGGATAAGCAAATTGGGATCTGGAAATGAT TTTGAGGTGTTCTTCCAACGACTTGGAATTGCTTCAGGCAGAGCACGGTATACTAAAAATTGGA AACAAACAAATTCAGCGGCTATCCACTGTATCACAGTGTCTATGAAACATATGAGTTGGTGGAAA AGTTTTATGATCCAATGTTTAAATATCACCTCACTGTGGCCCAGGTTCGAGGAGGGATGGTGTTT GAGCTAGCCAATTCCATAGTGCTCCCTTTTGATTGTCGAGATTATGCTGTAGTTTTAAGAAAGTA TGCTGACAAAATCTACAGTATTTCTATGAAACATCCACAGGAAATGAAGGCGTACATGGTATCAT TTGATTCACTTTTTTCTGCAGTAAAGAATTTTACAGAAATTGCTTCCAAGTTCAGTGAGAGACTC CAGGACTTTGACAAAAGCAACCCAATAGTATTAAGAATGATGAATGATCAACTCATGTTTCTGGA AAGAGCATTTATTGATCCATTAGGGTTACCAGACAGGCCTTTTTATAGGCATGTCATCTATGCTC CAAGCAGCCACAACAAGTATGCAGGGGAGTCATTCCCAGGAATTTATGATGCTCTGTTTGATATT AATAACAAAGTGGACACTTCCAAGGCCTGGGGAGAAGTGAAGAGACAGATTTATGTTGCAGCCTT CACAGTGCAGGCAGCTGCAGAGACTTTGAGTGAAGTGGCCTCCGGGGATTACAAGGACGACGATG ACAAGTAA |
| 208. | mutated human PSMA antigen | artificial | aa | MWNLLHETDSAVATARRPRWLCAGALVLAGGFFLLGFLFGWFIKSSNEATNITPKHNMKAFLDEL KAENIKKFLYNFTQIPHLAGTEQNFQLAKQIQSQWKEFGLDSVELAHYDVLLSYPNKTHPNYISI INEDGNEIFKTSLFEPPPPGYENVSDIVPPFSAFSPQGTPEGDLVYVNYARTEDFFKLERVMKIN CSGKIVIARYGKVFRGNKVKNAQLAGAKGVILYSDPADYFAPGVKSYPDGWNLPGGGVQRGNILN LNGAGDPLTPGYPANEYAYRRGIAEEAVGLPSIPVHPIGYYDAQKLLEHMGGSAPPDSSWRGSLKV PYNVGPGFAGNFSKQKVKLHIHSNEVTRIYNVIGTLRGAVEPDRYVILGGHRDSWVFGGIDPQS GAAVVHEIVRSFGTLKKEGWRPRRTILFASWDAEEFGLLGSTEWAEENSRLLQERGVAYINADSS IEGNYTLRVDCTPLMYSLVHNLTKELKSPDEGFEGKSLYESWTKKSPSPEFSGMPRISKLGSGND FEVFFQRLGIASGRARYTKNWETNKFSGYPLHSVYETYELVEKFYDPMFKYHLTVAQVRGGMVF ELANSIVLPFDCRDYAVVLRKYADKIYSISMKHPQEMKAYMVSFDSLFSAVKNFTEIASKFSERL QDFDKSNPIVLRMMNDQLMFLERAFIDPLGLPDRPFYRHVIYAPSSHNKYAGESFPGIYDALFDI NNKVDTSKAWGEVKRQIYVAAFTVQAAAETLSEVASGDYKDDDDK |
| 209. | mutated rat PSMA antigen | artificial | nt | ATGTGGAACGCTCAGCAGGACAGCGACTCCGCGGAGGCCCTGGGACGCCGCCAACGCTGGTTCTG TGCTGGAACACTGGTGCTGGCTTTCACTGGAACCTTCATCATTGGCTTCCTCTTTGGGTGGTTTA TAAAACCCTCCAATGATTCTACTAGCGTCTCATACCCTGGCATGAAGAAGGCATTTTTGCAA GAATTGAAGGCTGAGAACATCAAAAAATTTTTATACAATTTCACACGGACACCACATTTGGCAGG GACACAACACAATTTTGAGCTTGCAAAGCAAATTCATGCCCAGTGGAAAGAATTTGGCCTGGATT TGGTTGAGTTATCTGATTATGATGTCCTGTTGTCCTACCCAAATAAGACCCATCCCAACTATATC TCAATAATTAATGAAGATGGAAATGAGATTTTCAACACATCATTAGCTGAACTGTCACCCCGGG ATATGAGAACATATCAGATGTAGTGCCACCATACAGTGCCTTCTCTCCACAAGGGATGCCAGAGG GGATCTAGTATATGTTAACTATGCACGAACTGAAGACTTCTTTAAACTGGAACGGGACATGAAG |

-continued

| SEQ ID NO. | DESIGNATION | SOURCE | TYPE | SEQUENCE |
|---|---|---|---|---|
| | | | | ATCAATTGTTCTGGGAAGATTGTCATCGCCAGATATGGGCAAGTGTTCAGAGGAAATAAGGTTAA |
| | | | | AAATGCTCAGCTGGCAGGTGCAAAAGGAATCATTCTGTACTCAGACCCTGCTGATTACTTTGTTC |
| | | | | CTGGGGTGAAGTCCTATCCAGATGGTTGGAACCTCCCTGGAGGTGGTGTTCAGCGTGGAAATGTC |
| | | | | TTAAATCTTAATGGTGCAGGTGATCCCCTCACACCAGGTTATCCAGCAAATGAATATGCCTACAG |
| | | | | GCATGAGTTCACAGAAGCTGTCGGTCTGCCATCCATCCAATTGGATATGATGATG |
| | | | | CACAGAAACTATTAGAAAAATGGGTGGCTCCGCACCCCCTGACAGCAGCTGGAAGGGAGGACTA |
| | | | | AAAGTGCCTTACAACGTGGGACCTGGCTTTACTGGAAACTTTTCAACACAAAAGGTCAAGATGCA |
| | | | | TATTCACTCCTACAATAAAGTGACAAGAATCTACAATGTTATTGGTACCCTCAAAGGAGCTGTGG |
| | | | | AACCAGACAGATATGTTATTCTTGGAGGGCACAGAGATGCTTGGGTGTTTGGTGGCATTGACCCT |
| | | | | CAGAGTGGAGCAGCTGTTGTTCATGAAATTGTCAGGACCTTTGGAACTCTGAAGAAGAAAGGTTG |
| | | | | GAGGCCTAGAAGAACTATTTTGTTTGCAAGCTGGGATGCTGAAGAATTTGGCCTTCTTGGTTCTA |
| | | | | CTGAGTGGGCAGAGGAACATTCAAGACTCTTACAAGAACGTGGTGTGGCTTATATCAACGCTGAT |
| | | | | TCTTCCATAGAAGGAAACTACACTCTCAGAGTTGATTGCACACCACTGATGCACAGCTTAGTATA |
| | | | | CAACCTAACAAAAGAGCTGCCAAGCCCGGATGAAGGCTTTGAAGGCAAATCTCTTTATGCAGCT |
| | | | | GGAAAGAAAAAGTCCTTCAACTGAGTTCATTGGAATGCCAAGGATTAGCAAGCTGGGGTCTGGC |
| | | | | AATGATTTTGAAGTGTTTTTCCAAAGACTTGGAATTGCTTCAGGCAGAGCCCGGTATACTAAAAA |
| | | | | TTGGAAAAACAACAAAGTCAGCAGCTATCCTCTCTATCACAGTGTCTATGAAACATACGAATTGG |
| | | | | TAGAAAAATTCTATGATCCGACATTTAAATATCACCTCACTGTGGCCCAGGTTCGAGGAGCAATG |
| | | | | GTATTTGAATTGGCCAATTCTATAGTGCTTCCCTTTGACTGCCAAAGTTATGCTGTAGCTCTGAA |
| | | | | GAAACATGCTGAGACTATCTACAACATTTCAATGAATCATCCACAGGAGATGAAGACATACAGTA |
| | | | | TATCATTTGATTCGCTGTTTTCTGCAGTAAATAATTTTACAGATGTTGCATCCAAGTTCAATCAG |
| | | | | AGACTGCAAGACTTAGACAAGAGCAACCCCATATTACTGAGAATTTTGAATGATCAGCTAATGTA |
| | | | | TCTGGAACGTGCATTCATTGATCCTTTAGGATTACCAGGAAGGCCTTTCTACAGGCATATCATCT |
| | | | | ATGCTCCAAGCAGCCACAACAAGTATGCAGGAGAATCATTCCCAGGGATTTATGATGCCCTTTTT |
| | | | | GATATTGAAAGCAAAGTCGATCCTTCTAAGGCCTGGAGAGAAGTGAAGAGACAGATTTCTATTGC |
| | | | | AGCCTTCACAGTGCAAGCTGCAGCAGAGACTCTGAGAGAAGTAGACTCCGGGGATTACAAGGACG |
| | | | | ACGATGACAAGTAA |
| 210. | mutated rat PSMA antigen | artificial | aa | MWNAQQDSDSAEALGRRQRWFCAGTLVLAFTGTFIIGFLFGWFIKPSNDSTSSVSYPGMKKAFLQ ELKAENIKKFLYNFTRTPHLAGTQHNFELAKQIHAQWKEFGLDLVELSDYDVLLSYPNKTHPNYI SIINEDGNEIFNTSLAELSPPGYENISDVVPPYSAFSPQGMPEGDLVYVNYARTEDFFKLERDMK INCSGKIVIARYGVERGNKVKNAQLAGAKGIILYSDPADYFVPGVKSYPDGWNLPGGGVQRGNV LNLNGAGDPLTPGYPANEYAYRHEFTEAVGLPSIPVHPIGYDDAQKLLEKMGGSAPPDSSWKGGL KVPYNVGPGFTGNFSTQKVKMHIHSYNKVTRIYNVIGTLKGAVEPDRYVILGGHRDAWVFGGIDP QSGAAVVHEIVRTFGTLKKKGWRPRRTILFASWDAEEFGLLGSTEWAEEHSRLLQERGVAYINAD SSIEGNYTLRVDCTPLMHSLVYNLTKELPSPDEGFEGKSLYDSWKEKSPSTEFIGMPRISKLGSG NDFEVFFQRLGIASGRARYTKNWKNNKVSSYPLYHSVYETYELVEKFYDPTFKYHLTVAQVRGAM VFELANSIVLPFDCQSYAVALKKHAETIYNISMNHPQEMKTYSISFDSLFSAVNNFTDVASKFNQ RLQDLDKSNPILLRILNDQLMYLERAFIDPLGLPGRPFYRHIIYAPSSHNKYAGESFPGIYDALF DIESKVDPSKAWREVKRQISIAAFTVQAAAETLREVDSGDYKDDDDK |
| 211. | 5'-VH-family specific primer MVH1 | artificial | nt | (GC)AG GTG CAG CTC GAG GAG TCA GGA CCT |
| 212. | 5'-VH-family specific primer MVH2 | artificial | nt | GAG GTC CAG CTC GAG CAG TCT GGA CCT |
| 213. | 5'-VH-family specific primer MVH3 | artificial | nt | CAG GTC AAA CTC GAG CAG CCT GGG GCT |
| 214. | 5'-VH-family specific primer MVH4 | artificial | nt | GAG GTT CAG CTC GAG CAG TCT GGG GCA |
| 215. | 5'-VH-family specific primer MVH5 | artificial | nt | GA(AG) GTG AAG CTC GAG GAG TCT GGA GGA |
| 216. | 5'-VH-family specific primer MVH6 | artificial | nt | GAG GTG AAG CTT CTC GAG TCT GGA GGT |
| 217. | 5'-VH-family specific primer MVH7 | artificial | nt | GAA GTG AAG CTC GAG GAG TCT GGG GGA |
| 218. | 5'-VH-family specific primer MVH8 | artificial | nt | GAG GTT CAG CTC GAG CAG TCT GGA GCT |
| 219. | 3'-VH primer 3'MuVHBstEII | artificial | nt | TGA GGA GAC GGT GAC CGT GGT CCC TTG GCC CCA G |

| SEQ ID NO. | DESIGNATION | SOURCE | TYPE | SEQUENCE |
|---|---|---|---|---|
| 220. | 5'-VK-family specific primer MUVK1 | artificial | nt | CCA GTT CCG AGC TCG TTG TGA CTC AGG AAT CT |
| 221. | 5'-VK-family specific primer MUVK2 | artificial | nt | CCA GTT CCG AGC TCG TGT TGA CGC AGC CGC CC |
| 222. | 5'-VK-family specific primer MUVK3 | artificial | nt | CCA GTT CCG AGC TCG TGC TCA CCC AGT CTC CA |
| 223. | 5'-VK-family specific primer MUVK4 | artificial | nt | CCA GTT CCG AGC TCC AGA TGA CCC AGT CTC CA |
| 224. | 5'-VK-family specific primer MUVK5 | artificial | nt | CCA GAT GTG AGC TCG TGA TGA CCC AGA CTC CA |
| 225. | 5'-VK-family specific primer MUVK6 | artificial | nt | CCA GAT GTG AGC TCG TCA TGA CCC AGT CTC CA |
| 226. | 5'-VK-family specific primer MUVK7 | artificial | nt | CCA GTT CCG AGC TCG TGA TGA CAC AGT CTC CA |
| 227. | 3'-VK primer 3'MuVkHindIII/BsiW1 | artificial | nt | TGG TGC ACT AGT CGT ACG TTT GAT CTC AAG CTT GGT CCC |
| 228. | macaque PSMA forward primer | artificial | nt | CACTGTGGCCCAGGTTCGAGG |
| 229. | macaque PSMA reverse primer | artificial | nt | GACATACCACACAAATTCAATACGG |
| 230. | macaque PSMA forward primer | artificial | nt | GCTCTGCTCGCGCCGAGATGTGG |
| 231. | macaque PSMA reverse primer | artificial | nt | ACGCTGGACACCACCTCCAGG |
| 232. | macaque PSMA forward primer | artificial | nt | GGTTCTACTGAGTGGGCAGAGG |
| 233. | macaque PSMA reverse primer | artificial | nt | ACTTGTTGTGGCTGCTTGGAGC |
| 234. | macaque PSMA forward primer | artificial | nt | GGGTGAAGTCCTATCCAGATGG |
| 235. | macaque PSMA reverse primer | artificial | nt | GTGCTCTGCCTGAAGCAATTCC |
| 236. | macaque PSMA forward primer | artificial | nt | CTCGGCTTCCTCTTCGGGTGG |
| 237. | macaque PSMA reverse primer | artificial | nt | GCATATTCATTTGCTGGGTAACCTGG |
| 238. | macaque PSMA | artificial | nt | ATGTGGAATCTCCTGCACGAAACCGACTCGGCTGTGGCCACCGCGCGCCGCCCGCGCTGGCTGTG CGCTGGGGCACTGGTGCTGGCGGGTGGCTTCTTTCTCCTCGGCTTCCTCTTCGGATGGTTTATAA AATCCTCCAGTGAAGCTACTAACATTACTCCAAAGCATAATATGAAAGCATTTTTGGATGAACTG AAAGCTGAGAACATCAAGAAGTTCTTACATAATTTTACACAGATACCACATTTAGCAGGAACAGA ACAAAACTTTCAACTTGCAAAGCAAATTCAATCCCAGTGGAAAGAATTTGGCCTGGATTCTGTTG AGCTAACTCATTATGATGTCCTGTTGTCCTACCCAAATAAGACTCATCCCAACTACATCTCAATA ATTAATGAAGATGGAAATGAGATTTTCAACACATCATTATTTGAACCACCTCCTGCAGGATATGA AAATGTTTCGGATATTGTACCACCTTTCAGTGCTTTCTCTCCTCAAGGAATGCCAGAGGGCGATC TAGTGTATGTTAACTATGCACGAACTGAAGACTTCTTTAAATTGGAACGGGACATGAAAATCAAT TGCTCTGGGAAAATTGTAATTGCCAGATATGGGAAAGTTTTCAGAGGAAATAAGGTTAAAAATGC CCAGCTGGCAGGGGCCACAGGAGTCATTCTCTACTCAGACCCTGCTGACTACTTTGCTCCTGGGG TAAAGTCTTATCCAGATGGTTGGAATCTTCCTGGAGGTGGTGTCCAGCGTGGAAATATCCTAAAT |

| SEQ ID NO. | DESIGNATION | SOURCE | TYPE | SEQUENCE |
|---|---|---|---|---|
| | | | | CTGAATGGTGCAGGAGACCCTCTCACACCAGGTTACCCAGCAAATGAATATGCTTATAGGCGTGG<br>AATGGCAGAGGCTGTTGGTCTTCCAAGTATTCCCGTTCATCCAATTGGGTACTATGATGCACAGA<br>AGCTCCTAGAAAAAATGGGTGGCTCAGCATCACCAGATAGCAGCTGGAGAGGAAGTCTCAAGTG<br>CCCTACAATGTTGGACCTGGCTTTACTGGAAACTTTTCTACACAAAAAGTCAAGATGCACATCCA<br>CTCTACCAGTGAAGTGACAAGAATTTACAATGTGATAGGTACTCTCAGAGGAGCAGTGGAACCAG<br>ACAGATACGTCATTCTGGGAGGTCACCGGGACTCATGGGTGTTTGGTGGTATTGACCCTCAGAGT<br>GGAGCAGCTGTTGTTCATGAATTGTGAGGAGCTTTGGAACGCTGAAAAAGGAAGGTGGAGACC<br>TAGAAGAACAATTTTGTTTGCAAGCTGGGATGCAGAAGAATTTGGTCTTCTTGGTTCTACTGAAT<br>GGGCAGAGGAGAATTCAAGCTCCTTCAAGAGCGTGGCGTGGCTTATATTAATGCTGATTCGTCT<br>ATAGAGGGAAACTACACTCTGAGAGTTGATTGTACACCACTGATGTACAGCTTGGTATACAACCT<br>AACAAAAGAGCTGGAAGCCCTGATGAAGGCTTTGAAGGCAAATCTCTTTATGAAAGTTGGACTA<br>AAAAAAGTCCTTCCCCCGAGTTCAGTGGCATGCCCAGGATAAGCAAATTGGGATCTGGAAATGAT<br>TTTGAGGTGTTCTTCCAACGACTTGGAATTGCCTCAGGCAGAGCACGGTATACTAAAAATTGGGA<br>AACAAACAAATTCAGCAGCTATCCACTGTATCACAGTGTCTATGAGACATATGAGTTGGTGGAAA<br>AGTTTTATGATCCAATGTTTAAATATCACCTCACTGTGGCCCAGGTTCGAGGAGGGATGGTGTTT<br>GAACTAGCCAATTCCGTAGTGCTCCCCTTTTGATTGTCGAGATTATGCTGTAGTTTTAAGAAAGTA<br>TGCTGACAAAATCTACAATATTTCTATGAAACATCCACAGGAAATGAAGACATACAGTGTATCAT<br>TTGATTCACTTTTTTCTGCAGTAAAGAATTTTACAGAAATTGCTTCCAAGTTCAGCGAGAGACTC<br>CGGGACTTTGACAAAAGCAACCCAATATTATTAAGAATGATGAATGATCAACTCATGTTTCTGGA<br>AAGAGCATTTATTGATCCATTAGGGTTACCAGACAGACCTTTTTATAGGCATGTCATCTATGCTC<br>CAAGCAGCCACAACAAGTATGCAGGGGAGTCATTCCCAGGAATTTATGATGCTCTGTTTGATATC<br>GAAAGCAAAGTGGACCCTTCCCAGGCCTGGGGAGAAGTGAAGAGACAGATTTCTGTTGCAACCTT<br>CACAGTGCAAGCAGCTGCAGAGACTTTGAGTGAAGTGGCCTAA |
| 239. | macaque PSMA | artificial | aa | MWNLLHETDSAVATARRPRWLCAGALVLAGGFFLLGFLFGWFIKSSSEATNITPKHNMKAFLDEL<br>KAENIKKFLHNFTQIPHLAGTEQNFQLAKQIQSQWKEFGLDSVELTHYDVLLSYPNKTHPNYISI<br>INEDGNEIFNTSLFEPPPAGYENVSDIVPPFSAFSPQGMPEGDLVYVNYARTEDFFKLERDMKIN<br>CSGKIVIARYGKVFRGNKVKNAQLAGATGVILYSDPADYFAPGVKSYPDGWNLPGGGVQRGNILN<br>LNGAGDPLTPGYPANEYAYRRGMAEAVGLPSIPVHPIGYYDAQKLLEKMGGSASPDSSWRGSLKV<br>PYNVGPGFTGNFSTQKVKMHIHSTSEVTRIYNVIGTLRGAVEPDRYVILGGHRDSWVFGGIDPQS<br>GAAVVHEIVRSFGTLKKEGWRPRRTILFASWDAEEFGLLGSTEWAEENSRLLQERGVAYINADSS<br>IEGNYTLRVDCTPLMYSLVYNLTKELESPDEGFEGKSLYESWTKKSPSPEFSGMPRISKLGSGND<br>FEVFFQRLGIASGRARYTKNWETNKFSSYPLYHSVYETYELVEKFYDPMFKYHLTVAQVRGGMVF<br>ELANSVVLPFDCRDYAVVLRKYADKIYNISMKHPQEMKTYSVSFDSLFSAVKNFTEIASKFSERL<br>RDFDKSNPILLRMMNDQLMFLERAFIDPLGLPDRPFYRHVIYAPSSHNKYAGESFPGIYDALFDI<br>ESKVDPSQAWGEVKRQISVATFTVQAAAETLSEVA |
| 240. | PSMA D3 L | artificial | aa | DIVMTQSHKFMSTSVGDRVSIICKASQDVGTAVDWYQQKPGQSPKLLIYWASTRHTGVPDRFTGS<br>GSGTDFTLTITNVQSEDLADYFCQQYNSYPLTFGAGTMLDLK |
| 241. | PSMA D3 LCDR1 | artificial | aa | KASQDVGTAVD |
| 242. | PSMA D3 LCDR2 | artificial | aa | WASTRHT |
| 243. | PSMA D3 LCDR3 | artificial | aa | QQYNSYPLT |
| 244. | PSMA D3 VL | artificial | nt | GACATCGTGATGACCCAGTCCCACAAGTTCATGTCCACCTCCGTGGGCGACCGGGTGTCCATCAT<br>CTGCAAGGCCTCCCAGGATGTGGGCACCGCCGTGGACTGGTATCAGCAGAAGCCTGGCCAGTCCC<br>CTAAGCTGCTGATCTACTGGGCCTCCACCAGACACACCGGCGTGCCTGACAGATTCACCGGCTCC<br>GGCTCTGGCACCGACTTCACCCTGACCATCACCAACGTGCAGTCCGAGGACCTGGCCGACTACTT<br>CTGCCAGCAGTACAACTCCTACCCTCTGACCTTCGGCGCTGGCACCATGCTGGACCTGAAG |
| 245. | PSMA D3 H | artificial | aa | EVQLQQSGPELVKPGTSVRISCKTSGYTFTEYTIHWVKQSHGKSLEWIGNINPNNGGTTYNQKFE<br>DKATLTVDKSSSTAYMELRSLTSEDSAVYYCAAGWNFDYWGQGTTLTVSS |
| 246. | PSMA D3 HCDR1 | artificial | aa | EYTIH |
| 247. | PSMA D3 HCDR2 | artificial | aa | NINPNNGGTTYNQKFED |
| 248. | PSMA D3 HCDR3 | artificial | aa | GWNFDY |
| 249. | PSMA D3 H | artificial | nt | GAAGTGCAGCTGCAGCAGTCCGGCCCTGAGCTGGTGAAGCCTGGCACCTCCGTGCGGATCTCTTG<br>CAAGACCTCCGGCTACACCTTCACCGAGTACACCATCCACTGGGTGAAACAGTCCCACGGCAAGT<br>CCCTGGAATGGATCGGCAACATCAACCCTAACAACGGCGGCACCACCTACAACCAGAAGTTCGAG<br>GACAAGGCCACCCTGACCGTGGACAAGTCCTCCTCCACCGCCTACATGGAACTGCGGTCCCTGAC<br>CTCCGAGGACTCCGCCGTGTACTACTGCGCCGCTGGCTGGAACTTCGACTACTGGGGCCAGGGCA<br>CCACACTGACCGTGTCCTCC |
| 250. | PSMA D3 LH | artificial | aa | DIVMTQSHKFMSTSVGDRVSIICKASQDVGTAVDWYQQKPGQSPKLLIYWASTRHTGVPDRFTGS<br>GSGTDFTLTITNVQSEDLADYFCQQYNSYPLTFGAGTMLDLKGGGGSGGGGSGGGGSEVQLQQSG<br>PELVKPGTSVRISCKTSGYTFTEYTIHWVKQSHGKSLEWIGNINPNNGGTTYNQKFEDKATLTVD<br>KSSSTAYMELRSLTSEDSAVYYCAAGWNFDYWGQGTTLTVSS |
| 251. | PSMA D3 LH | artificial | nt | GACATCGTGATGACCCAGTCCCACAAGTTCATGTCCACCTCCGTGGGCGACCGGGTGTCCATCAT<br>CTGCAAGGCCTCCCAGGATGTGGGCACCGCCGTGGACTGGTATCAGCAGAAGCCTGGCCAGTCCC |

| SEQ ID NO. | DESIGNATION | SOURCE | TYPE | SEQUENCE |
|---|---|---|---|---|
| | | | | CTAAGCTGCTGATCTACTGGGCCTCCACCAGACACACCGGCGTGCCTGACAGATTCACCGGCTCC
GGCTCTGGCACCGACTTCACCCTGACCATCACCAACGTGCAGTCCGAGGACCTGGCCGACTACTT
CTGCCAGCAGTACAACTCCTACCCTCTGACCTTCGGCGCTGGCACCATGCTGGACCTGAAGGGCG
GAGGGGGCTCTGGCGGCGGAGGAAGTGGAGGGGGCGGATCCGAAGTGCAGCTGCAGCAGTCCGGC
CCTGAGCTGGTGAAGCCTGGCACCTCCGTGCGGATCTCTTGCAAGACCTCCGGCTACACCTTCAC
CGAGTACACCATCCACTGGGTGAAACAGTCCCACGGCAAGTCCCTGGAATGGATCGGCAACATCA
ACCCTAACAACGGCGGCACCACCTACAACCAGAAGTTCGAGGACAAGGCCACCCTGACCGTGGAC
AAGTCCTCCTCCACCGCCTACATGGAACTGCGGTCCCTGACCTCCGAGGACTCCGCCGTGTACTA
CTGCGCCGCTGGCTGGAACTTCGACTACTGGGGCCAGGGCACCACACTGACCGTGTCCTCC |
| 252. | PSMA D3 LH x I2C HL | artificial | aa | DIVMTQSHKFMSTSVGDRVSIICKASQDVGTAVDWYQQKPGQSPKLLIYWASTRHTGVPDRFTGS
GSGTDFTLTITNVQSEDLADYFCQQYNSYPLTFGAGTMLDLKGGGGSGGGGSGGGGSEVQLQQSG
PELVKPGTSVRISCKTSGYTFTEYTIHWVKQSHGKSLEWIGNINPNNGGTTYNQKFEDKATLTVD
KSSSTAYMELRSLTSEDSAVYYCAAGWNFDYWGQGTTLTVSSGGGGSEVQLVESGGGLVQPGGSL
KLSCAASGFTFNKYAMNWVRQAPGKGLEWVARIRSKYNNYATYYADSVKDRFTISRDDSKNTAYL
QMNNLKTEDTAVYYCVRHGNFGNSYISYWAYWGQGTLVTVSSGGGGSGGGGSGGGGSQTVVTQEP
SLTVSPGGTVTLTCGSSTGAVTSGNYPNWVQQKPGQAPRGLIGGTKFLAPGTPARFSGSLLGGKA
ALTLSGVQPEDEAEYYCVLWYSNRWVFGGGTKLTVL |
| 253. | PSMA D3 LH x I2C HL | artificial | nt | GACATCGTGATGACCCAGTCCCACAAGTTCATGTCCACCTCCGTGGGCGACCGGGTGTCCATCAT
CTGCAAGGCCTCCCAGGATGTGGGCACCGCCGTGGACTGGTATCAGCAGAAGCCTGGCCAGTCCC
CTAAGCTGCTGATCTACTGGGCCTCCACCAGACACACCGGCGTGCCTGACAGATTCACCGGCTCC
GGCTCTGGCACCGACTTCACCCTGACCATCACCAACGTGCAGTCCGAGGACCTGGCCGACTACTT
CTGCCAGCAGTACAACTCCTACCCTCTGACCTTCGGCGCTGGCACCATGCTGGACCTGAAGGGCG
GAGGGGGCTCTGGCGGCGGAGGAAGTGGAGGGGGCGGATCCGAAGTGCAGCTGCAGCAGTCCGGC
CCTGAGCTGGTGAAGCCTGGCACCTCCGTGCGGATCTCTTGCAAGACCTCCGGCTACACCTTCAC
CGAGTACACCATCCACTGGGTGAAACAGTCCCACGGCAAGTCCCTGGAATGGATCGGCAACATCA
ACCCTAACAACGGCGGCACCACCTACAACCAGAAGTTCGAGGACAAGGCCACCCTGACCGTGGAC
AAGTCCTCCTCCACCGCCTACATGGAACTGCGGTCCCTGACCTCCGAGGACTCCGCCGTGTACTA
CTGCGCCGCTGGCTGGAACTTCGACTACTGGGGCCAGGGCACCACACTGACCGTGTCCTCCGAG
GTGGTGGATCCGAGGTGCAGCTGGTCGAGTCTGGAGGAGGATTGGTGCAGCCTGGAGGGTCATTG
AAACTCTCATGTGCAGCCTCTGGATTCACCTTCAATAAGTACGCCATGAACTGGGTCCGCCAGGC
TCCAGGAAAGGGTTTGGAATGGGTTGCTCGCATAAGAAGTAAATATAATAATTATGCAACATATT
ATGCCGATTCAGTGAAAGACAGGTTCACCATCTCCAGAGATGATTCAAAAAACACTGCCTATCTA
CAAATGAACAACTTGAAAACTGAGGACACTGCCGTGTACTACTGTGTGAGACATGGGAACTTCGG
TAATAGCTACATATCCTACTGGGCTTACTGGGGCCAAGGGACTCTGGTCACCGTCTCCTCAGGTG
GTGGTGGTTCTGGCGGCGGCGGCTCCGGTGGTGGTGGTTCTCAGACTGTTGTGACTCAGGAACCT
TCACTCACCGTATCACCTGGTGGAACAGTCACACTCACTTGTGGCTCCTCGACTGGGGCTGTTAC
ATCTGGCAACTACCCAAACTGGGTCCAACAAAAACCAGGTCAGGCACCCCGTGGTCTAATAGGTG
GGACTAAGTTCCTCGCCCCCGGTACTCCTGCCAGATTCTCAGGCTCCCTGCTTGGAGGCAAGGCT
GCCCTCACCCTCTCAGGGGTACAGCCAGAGGATGAGGCAGAATATTACTGTGTTCTATGGTACAG
CAACCGCTGGGTGTTCGGTGGAGGAACCAAACTGACTGTCCTA |
| 254. | PSMA P6 L | artificial | aa | DIVLTQSPASLAVSLGQRATISCRASESIDSYDNTFMHWYQQKPGQPPNLLIFRASILESGIPAR
FSGSGSGTDFTLTIYPVEADDVATYYCHQSIEDPYTFGGGTKLEIK |
| 255. | PSMA P6 LCDR1 | artificial | aa | RASESIDSYDNTFMH |
| 256. | PSMA P6 LCDR2 | artificial | aa | RASILES |
| 257. | PSMA P6 LCDR3 | artificial | aa | HQSIEDPYT |
| 258. | PSMA P6 VL | artificial | nt | GACATCGTGCTGACCCAGTCTCCAGCCTCCCTGGCTGTGTCTCTGGGCCAGCGGGCCACCATCTC
TTGCCGGGCCTCCGAGTCCATCGACTCCTACGACAACACCTTCATGCACTGGTATCAGCAGAAGC
CTGGCCAGCCTCCTAACCTGCTGATCTTCCAGGCCTCTATCCTGGAATCCGGCATCCCTGCCCGG
TTCTCCGGCTCTGGCTCCGGCACCGACTTCACCCTGACCATCTACCCTGTGGAGGCCGACGACGT
GGCCACCTACTACTGCCACCAGTCCATCGAGGACCCTTACACCTTCGGCGGAGGGACCAAGCTGG
AAATCAAG |
| 259. | PSMA P6 H | artificial | aa | EVQLQQSGPELVKPGASVKMSCKASGYTFTGYVMHWVKQPGQVLEWIGYINPYNDVTRYNGKFK
GKATLTSDKYSSTAYMELSGLTSEDSAVYYCARGENWYYFDSWGRGATLTVSS |
| 260. | PSMA P6 HCDR1 | artificial | aa | GYVMH |
| 261. | PSMA P6 HCDR2 | artificial | aa | YINPYNDVTRYNGKFKG |
| 262. | PSMA P6 HCDR3 | artificial | aa | GENWYYFDS |
| 263. | PSMA P6 H | artificial | nt | GAAGTGCAGCTGCAGCAGTCCGGCCCTGAGCTGGTGAAGCCTGGCGCCTCCGTGAAGATGTCCTG
CAAGGCCTCCGGCTACACCTTCACCGGCTACGTGATGCACTGGGTGAAACAGAAACCCGGCCAGG
TGCTGGAATGGATCGGCTACATCAACCCTTACAACGACGTGACCCGGTACAACGGCAAGTTCAAG
GGCAAGGCCACCCTGACCTCCGACAAGTACTCCTCCACCGCCTACATGGAACTGTCCGGCCTGAC
CTCTGAGGACTCCGCCGTGTACTACTGCGCCAGGGGCGAGAACTGGTACTACTTCGACTCCTGGG
GCAGAGGCGCTACCCTGACCGTGTCTTCC |

| SEQ ID NO. | DESIGNATION | SOURCE | TYPE | SEQUENCE |
|---|---|---|---|---|
| 264. | PSMA P6 LH | artificial | aa | DIVLTQSPASLAVSLGQRATISCRASESIDSYDNTFMHWYQQKPGQPPNLLIFRASILESGIPAR FSGSGSGTDFTLTIYPVEADDVATYYCHQSIEDPYTFGGGTKLEIKGGGGSGGGGSGGGGSEVQL QQSGPELVKPGASVKMSCKASGYTFTGYVMHWVKQKPGQVLEWIGYINPYNDVTRYNGKFKGKAT LTSDKYSSTAYMELSGLTSEDSAVYYCARGENWYYFDSWGRGATLTVSS |
| 265. | PSMA P6 LH | artificial | nt | GACATCGTGCTGACCCAGTCTCCAGCCTCCCTGGCTGTGTCTCTGGGCCAGCGGGCCACCATCTC TTGCCGGGCCTCCGAGTCCATCGACTCCTACGACAACACCTTCATGCACTGGTATCAGCAGAAGC CTGGCCAGCCTCCTAACCTGCTGATCTTCCGGGCCTCTATCCTGGAATCCGGCATCCCTGCCCGG TTCTCCGGCTCTGGCTCCGGCACCGACTTCACCCTGACCATCTACCCTGTGGAGGCCGACGACGT GGCCACCTACTACTGCCACCAGTCCATCGAGGACCCTTACACCTTCGGCGAGGGACCAAGCTGG AAATCAAGGGCGGAGGGGGATCTGGCGGCGGAGGAAGTGGAGGGGGCGGATCCGAAGTGCAGCTG CAGCAGTCCGGCCCTGAGCTGGTGAAGCCTGGCGCCTCCGTGAAGATGTCCTGCAAGGCCTCCGG CTACACCTTCACCGGCTACGTGATGCACTGGGTGAAACAGAAACCCGGCCAGGTGCTGGAATGGA TCGGCTACATCAACCCTTACAACGACGTGACCCGGTACAACGGCAAGTTCAAGGGCAAGGCCACC CTGACCTCCGACAAGTACTCCTCCACCGCCTACATGGAACTGTCCGGCCTGACCTCTGAGGACTC CGCCGTGTACTACTGCGCCAGGGGCGAGAACTGGTACTACTTCGACTCCTGGGGCAGAGGCGCTA CCCTGACCGTGTCTTCC |
| 266. | PSMA P6 LH x I2C HL | artificial | aa | DIVLTQSPASLAVSLGQRATISCRASESIDSYDNTFMHWYQQKPGQPPNLLIFRASILESGIPAR FSGSGSGTDFTLTIYPVEADDVATYYCHQSIEDPYTFGGGTKLEIKGGGGSGGGGSGGGGSEVQL QQSGPELVKPGASVKMSCKASGYTFTGYVMHWVKQKPGQVLEWIGYINPYNDVTRYNGKFKGKAT LTSDKYSSTAYMELSGLTSEDSAVYYCARGENWYYFDSWGRGATLTVSSGGGGSEVQLVESGGGL VQPGGSLKLSCAASGFTFNKYAMNWVRQAPGKGLEWVARIRSKYNNYATYYADSVKDRFTISRDD SKNTAYLQMNNLKTEDTAVYYCVRHGNFGNSYISYWAYWGQGTLVTVSSGGGGSGGGGSGGGGSQ TVVTQEPSLTVSPGGTVTLTCGSSTGAVTSGNYPNWVQQKPGQAPRGLIGGTKFLAPGTPARFSG SLLGGKAALTLSGVQPEDEAEYYCVLWYSNRWVFGGGTKLTVL |
| 267. | PSMA P6 LH x I2C HL | artificial | nt | GACATCGTGCTGACCCAGTCTCCAGCCTCCCTGGCTGTGTCTCTGGGCCAGCGGGCCACCATCTC TTGCCGGGCCTCCGAGTCCATCGACTCCTACGACAACACCTTCATGCACTGGTATCAGCAGAAGC CTGGCCAGCCTCCTAACCTGCTGATCTTCCGGGCCTCTATCCTGGAATCCGGCATCCCTGCCCGG TTCTCCGGCTCTGGCTCCGGCACCGACTTCACCCTGACCATCTACCCTGTGGAGGCCGACGACGT GGCCACCTACTACTGCCACCAGTCCATCGAGGACCCTTACACCTTCGGCGGAGGGACCAAGCTGG AAATCAAGGGCGGAGGGGGATCTGGCGGCGGAGGAAGTGGAGGGGGCGGATCCGAAGTGCAGCTG CAGCAGTCCGGCCCTGAGCTGGTGAAGCCTGGCGCCTCCGTGAAGATGTCCTGCAAGGCCTCCGG CTACACCTTCACCGGCTACGTGATGCACTGGGTGAAACAGAAACCCGGCCAGGTGCTGGAATGGA TCGGCTACATCAACCCTTACAACGACGTGACCCGGTACAACGGCAAGTTCAAGGGCAAGGCCACC CTGACCTCCGACAAGTACTCCTCCACCGCCTACATGGAACTGTCCGGCCTGACCTCTGAGGACTC CGCCGTGTACTACTGCGCCAGGGGCGAGAACTGGTACTACTTCGACTCCTGGGGCAGAGGCGCTA CCCTGACCGTGTCTTCCGGAGGTGGATCCGAGGTGCAGCTGGTCGAGTCTGGAGGAGGATTG GTGCAGCCTGGAGGGTCATTGAAACTCTCATGTGCAGCCTCTGGATTCACCTTCAATAAGTACGC CATGAACTGGGTCCGCCAGGCTCCAGGAAAGGGTTTGGAATGGGTTGCTCGCATAAGAAGTAAAT ATAATAATTATGCAACATATTATGCCGATTCAGTGAAAGACAGGTTCACCATCTCCAGAGATGAT TCAAAAAACACTGCCTATCTACAAATGAACAACTTGAAAACTGAAGACACTGCCGTGTACTACTG TGTGAGACATGGGAACTTCGGTAATAGCTACATATCCTACTGGGCTTACTGGGGCCAAGGGACTC TGGTCACCGTCTCCTCAGGTGGTGGTGGTTCTGGCGGCGGCGGCTCCGGTGGTGGTGGTTCTCAG ACTGTTGTGACTCAGGAACCTTCACTCACCGTATCACCTGGTGGAACAGTCACACTCACTTGTGG CTCCTCGACTGGGGCTGTTACATCTGGCAACTACCCAAACTGGGTCCAACAAAAACCAGGTCAGG CACCCCGTGGTCTAATAGGTGGGACTAAGTTCCTCGCCCCCGGTACTCCTGCCAGATTCTCAGGC TCCCTGCTTGGAGGCAAGGCTGCCCTCACCCTCTCAGGGGTACAGCCAGAGGATGAGGCAGAATA TTACTGTGTTCTATGGTACAGCAACCGCTGGGTGTTCGGTGGAGGAACCAAACTGACTGTCCTA |
| 268. | PSMA P1 L | artificial | aa | DIQMTQSPSSLSASVGDRVTITCRASQGISNYLAWYQQKTGKVPKFLIYEASTLQSGVPSRFSGG GSGTDFTLTISSLQPEDVATYYCQNYNSAPFTFGPGTKVDIK |
| 269. | PSMA P1 LCDR1 | artificial | aa | RASQGISNYLA |
| 270. | PSMA P1 LCDR2 | artificial | aa | EASTLQS |
| 271. | PSMA P1 LCDR3 | artificial | aa | QNYNSAPFT |
| 272. | PSMA P1 VL | artificial | nt | GACATCCAGATGACCCAGTCCCCCTCCTCCCTGTCTGCCTCCGTGGGCGACAGAGTGACCATCAC CTGCCGGGCCTCCAGGGCATCTCCAACTACCTGGCCTGGTATCAGCAGAAAACCGGCAAGGTGC CCAAGTTCCTGATCTACGAGGCCTCCACCCTGCAGTCCGGCGTGCCTTCCAGATTCTCTGGCGGC GGATCCGGCACCGACTTCACCCTGACCATCTCCAGCCTGCAGCCTGAGGACGTGGCCACCTACTA CTGCCAGAACTACAACTCCGCCCCTTTCACCTTCGGCCCTGGCACCAAGGTGGACATCAAG |
| 273. | PSMA P1 H | artificial | aa | QVQLVESGGGVVQPGRSLRLSCAASGFAFSRYGMHWVRQAPGKGLEWVAVIWYDGSNKYYADSVK GRFTISRDNSKNTQYLQMNSLRAEDTAVYYCARGGDFLYYYYGMDVWGQGTTVTVSS |
| 274. | PSMA P1 HCDR1 | artificial | aa | RYGMH |
| 275. | PSMA P1 HCDR2 | artificial | aa | VIWYDGSNKYYADSVKG |
| 276. | PSMA P1 HCDR3 | artificial | aa | GGDFLYYYYGMDV |

| SEQ ID NO. | DESIGNATION | SOURCE | TYPE | SEQUENCE |
|---|---|---|---|---|
| 277. | PSMA P1 H | artificial | nt | CAGGTGCAGCTGGTCGAGTCTGGCGGAGGGGTGGTCCAGCCTGGCCGGTCCCTGAGACTGTCTTG<br>CGCCGCCTCCGGCTTCGCCTTCTCCAGATACGGCATGCACTGGGTGCGCCAGGCTCCAGGCAAGG<br>GACTGGAATGGGTGGCCGTGATTTGGTACGACGGCTCCAACAAGTACTACGCCGACTCCGTGAAG<br>GGCCGGTTCACCATCTCCCGGGACAACTCCAAGAACACCCAGTACCTGCAGATGAACTCCCTGAG<br>GGCCAGAGGACACCGCCGTGTACTACTGCGCCAGAGGCGGCGACTTCCTGTACTACTACTATTACG<br>GCATGGACGTGTGGGGCCAGGGCACCACCGTGACAGTGTCTTCC |
| 278. | PSMA P1 LH | artificial | aa | DIQMTQSPSSLSASVGDRVTITCRASQGISNYLAWYQQKTGKVPKFLIYEASTLQSGVPSRFSGG<br>GSGTDFTLTISSLQPEDVATYYCQNYNSAPFTFGPGTKVDIKGGGGSGGGGSGGGGSQVQLVESG<br>GGVVQPGRSLRLSCAASGFAFSRYGMHWVRQAPGKGLEWVAVIWYDGSNKYYADSVKGRFTISRD<br>NSKNTQYLQMNSLRAEDTAVYYCARGGDFLYYYYYGMDVWGQGTTVTVSS |
| 279. | PSMA P1 LH | artificial | nt | GACATCCAGATGACCCAGTCCCCCTCCTCCCTGTCTGCCTCCGTGGGCGACAGAGTGACCATCAC<br>CTGCCGGGCCTCCCAGGGCATCTCCAACTACCTGGCCTGGTATCAGCAGAAAACCGGCAAGGTGC<br>CCAAGTTCCTGATCTACGAGGCCTCCACCCTGCAGTCCGGCGTGCCTTCCAGATTCTCTGGCGG<br>GGATCCGGCACCGACTTCACCCTGACCATCTCCAGCCTGCAGCCTGAGGACGTGGCCACCTACTA<br>CTGCCAGAACTACAACTCCGCCCCTTTCACCTTCGGCCCTGGCACCAAGGTGGACATCAAGGGCG<br>GAGGGGGCAGTGGCGGCGGAGGAAGTGGAGGGGGCGGATCTCAGGTGCAGCTGGTCGAGTCTGGC<br>GGAGGGGTGGTCCAGCCTGGCCGGTCCCTGAGACTGTCTTGCGCCGCCTCCGGCTTCGCCTTCTC<br>CAGATACGGCATGCACTGGGTGCGCCAGGCTCCAGGCAAGGGACTGGAATGGGTGGCCGTGATTT<br>GGTACGACGGCTCCAACAAGTACTACGCCGACTCCGTGAAGGGCCGGTTCACCATCTCCCGGGAC<br>AACTCCAAGAACACCCAGTACCTGCAGATGAACTCCCTGAGGGCAGAGGACACCGCCGTGTACTA<br>CTGCGCCAGAGGCGGCGACTTCCTGTACTACTACTATTACGGCATGGACGTGTGGGGCCAGGGCA<br>CCACCGTGACAGTGTCTTCC |
| 280. | PSMA P1 LH x I2C HL | artificial | aa | DIQMTQSPSSLSASVGDRVTITCRASQGISNYLAWYQQKTGKVPKFLIYEASTLQSGVPSRFSGG<br>GSGTDFTLTISSLQPEDVATYYCQNYNSAPFTFGPGTKVDIKGGGGSGGGGSGGGGSQVQLVESG<br>GGVVQPGRSLRLSCAASGFAFSRYGMHWVRQAPGKGLEWVAVIWYDGSNKYYADSVKGRFTISRD<br>NSKNTQYLQMNSLRAEDTAVYYCARGGDFLYYYYYGMDVWGQGTTVTVSSGGGGSEVQLVESGGG<br>LVQPGGSLKLSCAASGFTFNKYAMNWVRQAPGKGLEWVARIRSKYNNYATYYADSVKDRFTISRD<br>DSKNTAYLQMNNLKTEDTAVYYCVRHGNFGNSYISYWAYWGQGTLVTVSSGGGGSGGGGSGGGGS<br>QTVVTQEPSLTVSPGGTVTLTCGSSTGAVTSGNYPNWVQQKPGQAPRGLIGGTKFLAPGTPARFS<br>GSLLGGKAALTLSGVQPEDEAEYYCVLWYSNRWVFGGGTKLTVL |
| 281. | PSMA P1 LH x I2C HL | artificial | nt | GACATCCAGATGACCCAGTCCCCCTCCTCCCTGTCTGCCTCCGTGGGCGACAGAGTGACCATCAC<br>CTGCCGGGCCTCCCAGGGCATCTCCAACTACCTGGCCTGGTATCAGCAGAAAACCGGCAAGGTGC<br>CCAAGTTCCTGATCTACGAGGCCTCCACCCTGCAGTCCGGCGTGCCTTCCAGATTCTCTGGCGG<br>GGATCCGGCACCGACTTCACCCTGACCATCTCCAGCCTGCAGCCTGAGGACGTGGCCACCTACTA<br>CTGCCAGAACTACAACTCCGCCCCTTTCACCTTCGGCCCTGGCACCAAGGTGGACATCAAGGGCG<br>GAGGGGGCAGTGGCGGCGGAGGAAGTGGAGGGGGCGGATCTCAGGTGCAGCTGGTCGAGTCTGGC<br>GGAGGGGTGGTCCAGCCTGGCCGGTCCCTGAGACTGTCTTGCGCCGCCTCCGGCTTCGCCTTCTC<br>CAGATACGGCATGCACTGGGTGCGCCAGGCTCCAGGCAAGGGACTGGAATGGGTGGCCGTGATTT<br>GGTACGACGGCTCCAACAAGTACTACGCCGACTCCGTGAAGGGCCGGTTCACCATCTCCCGGGAC<br>AACTCCAAGAACACCCAGTACCTGCAGATGAACTCCCTGAGGGCAGAGGACACCGCCGTGTACTA<br>CTGCGCCAGAGGCGGCGACTTCCTGTACTACTACTATTACGGCATGGACGTGTGGGGCCAGGGCA<br>CCACCGTGACAGTGTCTTCCGGAGGTGGTGGATCCGAGGTGCAGCTGGTCGAGTCTGGAGGAGGA<br>TTGGTGCAGCCTGGAGGGTCATTGAAACTCTCATGTGCAGCTCTGGATTCACCTTCAATAAGTA<br>CGCCATGAACTGGGTCCGCCAGGCTCCAGGAAAGGGTTTGGAATGGGTTGCTCGCATAAGAAGTA<br>AATATAATAATTATGCAACATATTATGCCGATTCAGTGAAAGACAGGTTCACCATCTCCAGAGAT<br>GATTCAAAAAACACTGCCTATCTACAAATGAACAACTTGAAAACTGAGGACACTGCCGTGTACTA<br>CTGTGTGAGACATGGGAACTTCGGTAATAGCTACATATCCTACTGGGCTTACTGGGGCCAAGGGA<br>CTCTGGTCACCGTCTCCTCAGGTGGTGGTGGTTCTGGCGGCGGCGGCTCCGGTGGTGGTGGTTCT<br>CAGACTGTTGTGACTCAGGAACCTTCACTCACCGTATCACCTGGTGGAACAGTCACACTCACTTG<br>TGGCTCCTCGACTGGGGCTGTTACATCTGGCAACTACCCAAACTGGGTCCAACAAAAACCAGGTC<br>AGGCACCCCGTGGTCTAATAGGTGGGACTAAGTTCCTCGCCCCGGTACTCCTGCCAGATTCTCA<br>GGCTCCCTGCTTGGAGGCAAGGCTGCCCTCACCCTCTCAGGGGTACAGCCAGAGGATGAGGCAGA<br>ATATTACTGTGTTCTATGGTACAGCAACCGCTGGGTGTTCGGTGGAGGAACCAAACTGACTGTCC<br>TA |
| 282. | PSMA P2 L | artificial | aa | DIQMTQSPSSLSASVGDRVTITCRASQGITNYLAWFQQKPGKAPKSLIYAASSLQSGVPSKFSGS<br>GSGTDFSLTISSLQPEDFATYYCQQYNSYPITFGQGTRLEIK |
| 283. | PSMA P2 LCDR1 | artificial | aa | RASQGITNYLA |
| 284. | PSMA P2 LCDR2 | artificial | aa | AASSLQS |
| 285. | PSMA P2 LCDR3 | artificial | aa | QQYNSYPIT |
| 286. | PSMA P2 VL | artificial | nt | GACATCCAGATGACCCAGTCACCCTCCTCCCTGTCTGCCTCCGTGGGCGACAGAGTGACCATCAC<br>CTGCCGGGCCTCACAGGGCATCACCAACTACCTGGCCTGGTTCCAGCAGAAGCCTGGCAAGGCCC<br>CTAAGTCCCTGATCTACGCCGCCTCCTCTCTGCAGTCCGGCGTGCCTTCCAAGTTCTCCGGCTCC<br>GGCTCTGGCACCGACTTCTCCCTGACCATCTCCTCCCTGCAGCCTGAGGACTTCGCCACCTACTA<br>CTGCCAGCAGTACAACTCCTACCCTATCACCTTCGGCCAGGGCACCCGGCTGGAAATCAAG |

| SEQ ID NO. | DESIGNATION | SOURCE | TYPE | SEQUENCE |
|---|---|---|---|---|
| 287. | PSMA P2 H | artificial | aa | QVQLVESGGGVVQPGRSLRLSCAASGFTFSNYVMHWVRQAPGKGLEWVAIIWYDGSNKYYADSVK<br>GRFTISRDNSKNTLYLQMNSLRAEDTAVYYCAGGYNWNYEYHYYGMDVWGQGTTVTVSS |
| 288. | PSMA P2 HCDR1 | artificial | aa | NYVMH |
| 289. | PSMA P2 HCDR2 | artificial | aa | IIWYDGSNKYYADSVKG |
| 290. | PSMA P2 HCDR3 | artificial | aa | GYNWNYEYHYYGMDV |
| 291. | PSMA P2 H | artificial | nt | CAGGTGCAGCTGGTCGAGTCTGGCGGAGGGGTGGTGCAGCCTGGCCGGTCCCTGAGACTGTCTTG<br>CGCTGCCTCCGGCTTCACCTTCTCCAACTACGTGATGCACTGGGTGCGCCAGGCTCCAGGCAAGG<br>GACTGGAATGGGTGGCCATCATTTGGTACGACGGCTCCAACAAGTACTACGCCGACTCCGTGAAG<br>GGCCGGTTCACCATCTCCCGGGACAACTCCAAGAACACCCTGTACCTGCAGATGAACTCCCTGAG<br>GGCCGAGGACACCGCCGTGTACTACTGCGCTGGCGGCTACAACTGGAACTACGAGTACCACTACT<br>ACGGCATGGACGTGTGGGGCCAGGGAACCACCGTGACCGTGTCTTCC |
| 292. | PSMA P2 LH | artificial | aa | DIQMTQSPSSLSASVGDRVTITCRASQGITNYLAWFQQKPGKAPKSLIYAASSLQSGVPSKFSGS<br>GSGTDFSLTISSLQPEDFATYYCQQYNSYPITFGQGTRLEIKGGGGSGGGGSGGGGSQVQLVESG<br>GGVVQPGRSLRLSCAASGFTFSNYVMHWVRQAPGKGLEWVAIIWYDGSNKYYADSVKGRFTISRD<br>NSKNTLYLQMNSLRAEDTAVYYCAGGYNWNYEYHYYGMDVWGQGTTVTVSS |
| 293. | PSMA P2 LH | artificial | nt | GACATCCAGATGACCCAGTCACCCTCCTCCCTGTCTGCCTCCGTGGGCGACAGAGTGACCATCAC<br>CTGCCGGGCCTCACAGGGCATCACCAACTACCTGGCCTGGTTCCAGCAGAAGCCTGGCAAGGCCC<br>CTAAGTCCCTGATCTACGCCGCCTCCTCTCTGCAGTCCGGCGTGCCTTCCAAGTTCTCCGGCTCC<br>GGCTCTGGCACCGACTTCTCCCTGACCATCTCCTCCCTGCAGCCTGAGGACTTCGCCACCTACTA<br>CTGCCAGCAGTACAACTCCTACCCTATCACCTTCGGCCAGGGCACCCGGCTGGAAATCAAGGGCG<br>GAGGGGGATCTGGCGGCGGAGGAAGTGGAGGGGGCGGATCTCAGGTGCAGCTGGTCGAGTCTGGC<br>GGAGGGGTGGTGCAGCCTGGCCGGTCCCTGAGACTGTCTTGCGCTGCCTCCGGCTTCACCTTCTC<br>CAACTACGTGATGCACTGGGTGCGCCAGGCTCCAGGCAAGGACTGGAATGGGTGGCCATCATTT<br>GGTACGACGGCTCCAACAAGTACTACGCCGACTCCGTGAAGGGCCGGTTCACCATCTCCCGGGAC<br>AACTCCAAGAACACCCTGTACCTGCAGATGAACTCCCTGAGGGCCGAGGACACCGCCGTGTACTA<br>CTGCGCTGGCGGCTACAACTGGAACTACGAGTACCACTACTACGGCATGGACGTGTGGGGCCAGG<br>GAACCACCGTGACCGTGTCTTCC |
| 294. | PSMA P2 LH x I2C HL | artificial | aa | DIQMTQSPSSLSASVGDRVTITCRASQGITNYLAWFQQKPGKAPKSLIYAASSLQSGVPSKFSGS<br>GSGTDFSLTISSLQPEDFATYYCQQYNSYPITFGQGTRLEIKGGGGSGGGGSGGGGSQVQLVESG<br>GGVVQPGRSLRLSCAASGFTFSNYVMHWVRQAPGKGLEWVAIIWYDGSNKYYADSVKGRFTISRD<br>NSKNTLYLQMNSLRAEDTAVYYCAGGYNWNYEYHYYGMDVWGQGTTVTVSSGGGGSEVQLVESGG<br>GLVQPGGSLKLSCAASGFTFNKYAMNWVRQAPGKGLEWVARIRSKYNNYATYYADSVKDRFTISR<br>DDSKNTAYLQMNNLKTEDTAVYYCVRHGNFGNSYISYWAYWGQGTLVTVSSGGGGSGGGGSGGGG<br>SQTVVTQEPSLTVSPGGTVTLTCGSSTGAVTSGNYPNWVQQKPGQAPRGLIGGTKFLAPGTPARF<br>SGSLLGGKAALTLSGVQPEDEAEYYCVLWYSNRWVFGGGTKLTVL |
| 295. | PSMA P2 LH x I2C HL | artificial | nt | GACATCCAGATGACCCAGTCACCCTCCTCCCTGTCTGCCTCCGTGGGCGACAGAGTGACCATCAC<br>CTGCCGGGCCTCACAGGGCATCACCAACTACCTGGCCTGGTTCCAGCAGAAGCCTGGCAAGGCCC<br>CTAAGTCCCTGATCTACGCCGCCTCCTCTCTGCAGTCCGGCGTGCCTTCCAAGTTCTCCGGCTCC<br>GGCTCTGGCACCGACTTCTCCCTGACCATCTCCTCCCTGCAGCCTGAGGACTTCGCCACCTACTA<br>CTGCCAGCAGTACAACTCCTACCCTATCACCTTCGGCCAGGGCACCCGGCTGGAAATCAAGGGCG<br>GAGGGGGATCTGGCGGCGGAGGAAGTGGAGGGGGCGGATCTCAGGTGCAGCTGGTCGAGTCTGGC<br>GGAGGGGTGGTGCAGCCTGGCCGGTCCCTGAGACTGTCTTGCGCTGCCTCCGGCTTCACCTTCTC<br>CAACTACGTGATGCACTGGGTGCGCCAGGCTCCAGGCAAGGACTGGAATGGGTGGCCATCATTT<br>GGTACGACGGCTCCAACAAGTACTACGCCGACTCCGTGAAGGGCCGGTTCACCATCTCCCGGGAC<br>AACTCCAAGAACACCCTGTACCTGCAGATGAACTCCCTGAGGGCCGAGGACACCGCCGTGTACTA<br>CTGCGCTGGCGGCTACAACTGGAACTACGAGTACCACTACTACGGCATGGACGTGTGGGGCCAGG<br>GAACCACCGTGACCGTGTCTTCCGGAGGTGGTGGATCCGAGGTGCAGCTGGTCGAGTCTGGAGGA<br>GGATTGGTGCAGCCTGGAGGGTCATTGAAACTCTCATGTGCAGCCTCTGGATTCACCTTCAATAA<br>GTACGCCATGAACTGGGTCCGCCAGGCTCCAGGAAAGGGTTTGGAATGGGTTGCTCGCATAAGAA<br>GTAAATATAATAATTATGCAACATATTATGCCGATTCAGTGAAGACAGGTTCACCATCTCCAGA<br>GATGATTCAAAAAACACTGCCTATCTACAAATGAACAACTTGAAAACTGAGGACACTGCCGTGTA<br>CTACTGTGTGAGACATGGAACTTCGGTAATAGCTACATATCCTACTGGGCTTACTGGGGCCAAG<br>GGACTCTGGTCACCGTCTCCTCAGGTGGTGGTGGTTCTGGCGGCGGCGGCTCCGGTGGTGGTGGT<br>TCTCAGACTGTTGTGACTCAGGAACCTTCACTCACCGTATCACCTGGTGGAACAGTCACACTCAC<br>TTGTGGCTCCTCGACTGGGGCTGTTACATCTGGCAACTACCCAAACTGGGTCCAACAAAAACCAG<br>GTCAGGCACCCCGTGGTCTAATAGGTGGGACTAAGTTCCTCGCCCCCGGTACTCCTGCCAGATTC<br>TCAGGCTCCCTGCTTGGAGGCAAGGCTGCCCTCACCCTCTCAGGGGTACAGCCAGAGGATGAGGC<br>AGAATATTACTGTGTTCTATGGTACAGCAACCGCTGGGTGTTCGGTGGAGGAACCAAACTGACTG<br>TCCTA |
| 296. | PSMA P3 L | artificial | aa | DIQMTQSPSSLSASVGDRVTITCRASQGISHYLAWFQQKPGKAPKSLIYAASSLQSGVPSKFSGS<br>GSGTDFTLTISSLQPEDFATYYCQQYNSFPLTFGGGTKVEIK |
| 297. | PSMA P3 LCDR1 | artificial | aa | RASQGISHYLA |
| 298. | PSMA P3 LCDR2 | artificial | aa | AASSLQS |

-continued

| SEQ ID NO. | DESIGNATION | SOURCE | TYPE | SEQUENCE |
|---|---|---|---|---|
| 299. | PSMA P3 LCDR3 | artificial | aa | QQYNSFPLT |
| 300. | PSMA P3 VL | artificial | nt | GACATCCAGATGACCCAGTCTCCCTCCTCCCTGTCTGCCTCCGTGGGCGACAGAGTGACCATCAC<br>CTGCCGGGCCTCCCAGGGCATCTCTCACTACCTGGCCTGGTTCCAGCAGAAGCCTGGCAAGGCCC<br>CTAAGTCCCTGATCTACGCCGCCTCCTCTCTGCAGTCCGGCGTGCCTTCCAAGTTCTCCGGCTCC<br>GGCTCTGGCACCGACTTCACCCTGACCATCTCCAGCCTGCAGCCTGAGGACTTCGCCACCTACTA<br>CTGCCAGCAGTACAACTCCTTCCCTCTGACCTTCGGCGGAGGGACCAAGGTGGAGATCAAG |
| 301. | PSMA P3 H | artificial | aa | QVQLVESGGGVVQPGRSLRLSCAASGFTFSSYGMHWVRQAPGKGLDWVAIIWHDGSNKYYADSVK<br>GRFTISRDNSKKTLYLQMNSLRAEDTAVYYCARAWAYDYGDYEYYFGMDVWGQGTTVTVSS |
| 302. | PSMA P3 HCDR1 | artificial | aa | SYGMH |
| 303. | PSMA P3 HCDR2 | artificial | aa | IIWHDGSNKYYADSVKG |
| 304. | PSMA P3 HCDR3 | artificial | aa | AWAYDYGDYEYYFGMDV |
| 305. | PSMA P3 H | artificial | nt | CAGGTGCAGCTGGTCGAGTCTGGCGGAGGGGTGGTGCAGCCTGGCCGGTCCCTGAGACTGTCTTG<br>TGCCGCCTCCGGCTTCACCTTCTCCTCTTACGGCATGCACTGGGTGCGCCAGGCTCCAGGCAAGG<br>GACTGGACTGGGTGGCCATCATCTGGCACGACGGCTCCAACAAGTACTACGCCGACTCCGTGAAG<br>GGCCGGTTCACCATCTCCCGGGACAACTCCAAGAAAACCCTGTACCTGCAGATGAACTCCCTGAG<br>GGCCGAGGACACCGCCGTGTACTACTGTGCCAGGGCCTGGGCCTACGACTACGGCGACTACGAGT<br>ACTACTTCGGCATGGACGTGTGGGGCCAGGGCACCACCGTGACAGTGTCTTCC |
| 306. | PSMA P3 LH | artificial | aa | DIQMTQSPSSLSASVGDRVTITCRASQGISHYLAWFQQKPGKAPKSLIYAASSLQSGVPSKFSGS<br>GSGTDFTLTISSLQPEDFATYYCQQYNSFPLTFGGGTKVEIKGGGGSGGGGSGGGGSQVQLVESG<br>GGVVQPGRSLRLSCAASGFTFSSYGMHWVRQAPGKGLDWVAIIWHDGSNKYYADSVKGRFTISRD<br>NSKKTLYLQMNSLRAEDTAVYYCARAWAYDYGDYEYYFGMDVWGQGTTVTVSS |
| 307. | PSMA P3 LH | artificial | nt | GACATCCAGATGACCCAGTCTCCCTCCTCCCTGTCTGCCTCCGTGGGCGACAGAGTGACCATCAC<br>CTGCCGGGCCTCCCAGGGCATCTCTCACTACCTGGCCTGGTTCCAGCAGAAGCCTGGCAAGGCCC<br>CTAAGTCCCTGATCTACGCCGCCTCCTCTCTGCAGTCCGGCGTGCCTTCCAAGTTCTCCGGCTCC<br>GGCTCTGGCACCGACTTCACCCTGACCATCTCCAGCCTGCAGCCTGAGGACTTCGCCACCTACTA<br>CTGCCAGCAGTACAACTCCTTCCCTCTGACCTTCGGCGGAGGGACCAAGGTGGAGATCAAGGGCG<br>GAGGGGGCTCTGGCGGCGGAGGAAGTGGAGGGGGCGGATCTCAGGTGCAGCTGGTCGAGTCTGGC<br>GGAGGGGTGGTGCAGCCTGGCCGGTCCCTGAGACTGTCTTGTGCCGCCTCCGGCTTCACCTTCTC<br>CTCTTACGGCATGCACTGGGTGCGCCAGGCTCCAGGCAAGGGACTGGACTGGGTGGCCATCATCT<br>GGCACGACGGCTCCAACAAGTACTACGCCGACTCCGTGAAGGGCCGGTTCACCATCTCCCGGGAC<br>AACTCCAAGAAAACCCTGTACCTGCAGATGAACTCCCTGAGGGCCGAGGACACCGCCGTGTACTA<br>CTGTGCCAGGGCCTGGGCCTACGACTACGGCGACTACGAGTACTACTTCGGCATGGACGTGTGGG<br>GCCAGGGCACCACCGTGACAGTGTCTTCC |
| 308. | PSMA P3 LH x I2C HL | artificial | aa | DIQMTQSPSSLSASVGDRVTITCRASQGISHYLAWFQQKPGKAPKSLIYAASSLQSGVPSKFSGS<br>GSGTDFTLTISSLQPEDFATYYCQQYNSFPLTFGGGTKVEIKGGGGSGGGGSGGGGSQVQLVESG<br>GGVVQPGRSLRLSCAASGFTFSSYGMHWVRQAPGKGLDWVAIIWHDGSNKYYADSVKGRFTISRD<br>NSKKTLYLQMNSLRAEDTAVYYCARAWAYDYGDYEYYFGMDVWGQGTTVTVSSGGGGSEVQLVES<br>GGGLVQPGGSLKLSCAASGFTFNKYAMNWVRQAPGKGLEWVARIRSKYNNYATYYADSVKDRFTI<br>SRDDSKNTAYLQMNNLKTEDTAVYYCVRHGNFGNSYISYWAYWGQGTLVTVSSGGGGSGGGGSGG<br>GGSQTVVTQEPSLTVSPGGTVTLTCGSSTGAVTSGNYPNWVQQKPGQAPRGLIGGTKFLAPGTPA<br>RFSGSLLGGKAALTLSGVQPEDEAEYYCVLWYSNRWVFGGGTKLTVL |
| 309. | PSMA P3 LH x I2C HL | artificial | nt | GACATCCAGATGACCCAGTCTCCCTCCTCCCTGTCTGCCTCCGTGGGCGACAGAGTGACCATCAC<br>CTGCCGGGCCTCCCAGGGCATCTCTCACTACCTGGCCTGGTTCCAGCAGAAGCCTGGCAAGGCCC<br>CTAAGTCCCTGATCTACGCCGCCTCCTCTCTGCAGTCCGGCGTGCCTTCCAAGTTCTCCGGCTCC<br>GGCTCTGGCACCGACTTCACCCTGACCATCTCCAGCCTGCAGCCTGAGGACTTCGCCACCTACTA<br>CTGCCAGCAGTACAACTCCTTCCCTCTGACCTTCGGCGGAGGGACCAAGGTGGAGATCAAGGGCG<br>GAGGGGGCTCTGGCGGCGGAGGAAGTGGAGGGGGCGGATCTCAGGTGCAGCTGGTCGAGTCTGGC<br>GGAGGGGTGGTGCAGCCTGGCCGGTCCCTGAGACTGTCTTGTGCCGCCTCCGGCTTCACCTTCTC<br>CTCTTACGGCATGCACTGGGTGCGCCAGGCTCCAGGCAAGGGACTGGACTGGGTGGCCATCATCT<br>GGCACGACGGCTCCAACAAGTACTACGCCGACTCCGTGAAGGGCCGGTTCACCATCTCCCGGGAC<br>AACTCCAAGAAAACCCTGTACCTGCAGATGAACTCCCTGAGGGCCGAGGACACCGCCGTGTACTA<br>CTGTGCCAGGGCCTGGGCCTACGACTACGGCGACTACGAGTACTACTTCGGCATGGACGTGTGGG<br>GCCAGGGCACCACCGTGACAGTGTCTTCCGGAGGTGGTGGATCCGAGGTGCAGCTGGTCGAGTCT<br>GGAGGAGGATTGGTGCAGCCTGGAGGGTCATTGAAACTCTCATGTGCAGCCTCTGGATTCACCTT<br>CAATAAGTACGCCATGAACTGGGTCCGCCAGGCTCCAGGAAAGGGTTTGGAATGGGTTGCTCGCA<br>TAAGAAGTAAATATAATAATTATGCAACATATTATGCCGATTCAGTGAAAGACAGGTTCACCATC<br>TCCAGAGATGATTCAAAAAACACTGCCTATCTACAAATGAACAATTTGAAACTGAGGACACTGCC<br>CGTGTACTACTGTGTGAGACATGGGAACTTCGGTAATAGCTACATATCCTACTGGGCTTACTGGG<br>GCCAAGGGACTCTGGTCACCGTCTCCTCAGGTGGTGGTGGTTCGGCGGCGGCGGCTCCGGTGGT<br>GGTGGTTCTCAGACTGTTGTGACTCAGGAACCTTCACTCACCGTATCACCTGGTGGAACAGTCAC<br>ACTCACTTGTGGCTCCTCGACTGGGGCTGTTACATCTGGCAACTACCCAAACTGGGTCCAACAAA<br>AACCAGGTCAGGCACCCCGTGGTCTAATAGGTGGACTAAGTTCCTCGCCCCCGGTACTCCTGCC<br>AGATTCTCAGGCTCCCTGCTTGGAGGCAAGGCTGCCCTCACCCTCTCAGGGGTACAGCCAGAGGA |

| SEQ ID NO. | DESIGNATION | SOURCE | TYPE | SEQUENCE |
|---|---|---|---|---|
| | | | | TGAGGCAGAATATTACTGTGTTCTATGGTACAGCAACCGCTGGGTGTTCGGTGGAGGAACCAAAC<br>TGACTGTCCTA |
| 310. | PSMA P4 L | artificial | aa | DIVMTQTPLSLSVTPGQPASISCKSSQSLLHSDGKTFLYWYLQKPGQPPQLLIYEVSNRFSGVPD<br>RFSGSGSGTDFTLKISRVEAEDVGLYYCMQSIQLPLTFGGGTKVEIK |
| 311. | PSMA P4 LCDR1 | artificial | aa | KSSQSLLHSDGKTFLY |
| 312. | PSMA P4 LCDR2 | artificial | aa | EVSNRFS |
| 313. | PSMA P4 LCDR3 | artificial | aa | MQSIQLPLT |
| 314. | PSMA P4 VL | artificial | nt | GACATCGTGATGACCCAGACCCCTCTGTCCCTGTCTGTGACCCCTGGCCAGCCTGCCTCCATCTC<br>CTGCAAGTCCTCCCAGTCCCTGCTGCACTCCGACGGCAAGACCTTCCTGTACTGGTATCTGCAGA<br>AGCCCGGCCAGCCTCCTCAGCTGCTGATCTACGAGGTGTCCAACCGGTTCTCCGGCGTGCCTGAC<br>AGGTTCTCTGGCTCCGGCTCCGGCACCGACTTCACCCTGAAGATCTCCCGGGTGGAGGCTGAGGA<br>CGTGGGCCTGTACTACTGCATGCAGTCCATCCAGCTGCCTCTGACCTTCGGCGGAGGGACCAAGG<br>TGGAGATCAAG |
| 315. | PSMA P4 H | artificial | aa | QVQLVESGGGVVQPGRSLRLSCAASGFTFISYGMHWVRQAPGKGLEWVAVISYDGSNKYYADSVK<br>GRFTISRDNSKNTLYLQMNSLRAEDTAVYYCARVLVGALYYYNYYGMDVWGQGTTVTVSS |
| 316. | PSMA P4 HCDR1 | artificial | aa | SYGMH |
| 317. | PSMA P4 HCDR2 | artificial | aa | VISYDGSNKYYADSVKG |
| 318. | PSMA P4 HCDR3 | artificial | aa | VLVGALYYYNYYGMDV |
| 319. | PSMA P4 H | artificial | nt | CAGGTGCAGCTGGTCGAGTCTGGGGGAGGGGTCGTGCAGCCTGGCCGGTCCCTGAGACTGTCTTG<br>CGCCGCCTCCGGCTTCACCTTCATCTCTTACGGCATGCACTGGGTGCGCCAGGCTCCAGGCAAGG<br>GACTGGAATGGGTGGCCGTGATCTCCTACGACGGCTCCAACAAGTACTACGCCGACTCCGTGAAG<br>GGCCGGTTCACCATCTCCCGGGACAACTCCAAGAACACCCTGTACCTGCAGATGAACTCCCTGAG<br>GGCCGAGGACACCGCCGTGTACTACTGTGCCAGGGTGCTGGTCGGCGCTCTGTACTACTACAACT<br>ACTACGGCATGGACGTGTGGGGCCAGGGCACCACCGTGACAGTGTCTTCC |
| 320. | PSMA P4 LH | artificial | aa | DIVMTQTPLSLSVTPGQPASISCKSSQSLLHSDGKTFLYWYLQKPGQPPQLLIYEVSNRFSGVPD<br>RFSGSGSGTDFTLKISRVEAEDVGLYYCMQSIQLPLTFGGGTKVEIKGGGGSGGGGSGGGGSQVQ<br>LVESGGGVVQPGRSLRLSCAASGFTFISYGMHWVRQAPGKGLEWVAVISYDGSNKYYADSVKGRF<br>TISRDNSKNTLYLQMNSLRAEDTAVYYCARVLVGALYYYNYYGMDVWGQGTTVTVSS |
| 321. | PSMA P4 LH | artificial | nt | GACATCGTGATGACCCAGACCCCTCTGTCCCTGTCTGTGACCCCTGGCCAGCCTGCCTCCATCTC<br>CTGCAAGTCCTCCCAGTCCCTGCTGCACTCCGACGGCAAGACCTTCCTGTACTGGTATCTGCAGA<br>AGCCCGGCCAGCCTCCTCAGCTGCTGATCTACGAGGTGTCCAACCGGTTCTCCGGCGTGCCTGAC<br>AGGTTCTCTGGCTCCGGCTCCGGCACCGACTTCACCCTGAAGATCTCCCGGGTGGAGGCTGAGGA<br>CGTGGGCCTGTACTACTGCATGCAGTCCATCCAGCTGCCTCTGACCTTCGGCGGAGGGACCAAGG<br>TGGAGATCAAGGGCGGAGGGGGCTCTGGCGGCGGAGGAAGTGGAGGGGGCGGATCTCAGGTGCAG<br>CTGGTCGAGTCTGGGGGAGGGGTCGTGCAGCCTGGCCGGTCCCTGAGACTGTCTTGCGCCGCCTC<br>CGGCTTCACCTTCATCTCTTACGGCATGCACTGGGTGCGCCAGGCTCCAGGCAAGGGACTGGAAT<br>GGGTGGCCGTGATCTCCTACGACGGCTCCAACAAGTACTACGCCGACTCCGTGAAGGGCCGGTTC<br>ACCATCTCCCGGGACAACTCCAAGAACACCCTGTACCTGCAGATGAACTCCCTGAGGGCCGAGGA<br>CACCGCCGTGTACTACTGTGCCAGGGTGCTGGTCGGCGCTCTGTACTACTACAACTACTACGGCA<br>TGGACGTGTGGGGCCAGGGCACCACCGTGACAGTGTCTTCC |
| 322. | PSMA P4<br>LH x I2C HL | artificial | aa | DIVMTQTPLSLSVTPGQPASISCKSSQSLLHSDGKTFLYWYLQKPGQPPQLLIYEVSNRFSGVPD<br>RFSGSGSGTDFTLKISRVEAEDVGLYYCMQSIQLPLTFGGGTKVEIKGGGGSGGGGSGGGGSQVQ<br>LVESGGGVVQPGRSLRLSCAASGFTFISYGMHWVRQAPGKGLEWVAVISYDGSNKYYADSVKGRF<br>TISRDNSKNTLYLQMNSLRAEDTAVYYCARVLVGALYYYNYYGMDVWGQGTTVTVSSGGGGSEVQ<br>LVESGGGLVQPGGSLKLSCAASGFTFNKYAMNWVRQAPGKGLEWVARIRSKYNNYATYYADSVKD<br>RFTISRDDSKNTAYLQMNNLKTEDTAVYYCVRHGNFGNSYISYWAYWGQGTLVTVSSGGGGSGGG<br>GSGGGGSQTVVTQEPSLTVSPGGTVTLTCGSSTGAVTSGNYPNWVQQKPGQAPRGLIGGTKFLAP<br>GTPARFSGSLLGGKAALTLSGVQPEDEAEYYCVLWYSNRWVFGGGTKLTVL |
| 323. | PSMA P4<br>LH x I2C HL | artificial | nt | GACATCGTGATGACCCAGACCCCTCTGTCCCTGTCTGTGACCCCTGGCCAGCCTGCCTCCATCTC<br>CTGCAAGTCCTCCCAGTCCCTGCTGCACTCCGACGGCAAGACCTTCCTGTACTGGTATCTGCAGA<br>AGCCCGGCCAGCCTCCTCAGCTGCTGATCTACGAGGTGTCCAACCGGTTCTCCGGCGTGCCTGAC<br>AGGTTCTCTGGCTCCGGCTCCGGCACCGACTTCACCCTGAAGATCTCCCGGGTGGAGGCTGAGGA<br>CGTGGGCCTGTACTACTGCATGCAGTCCATCCAGCTGCCTCTGACCTTCGGCGGAGGGACCAAGG<br>TGGAGATCAAGGGCGGAGGGGGCTCTGGCGGCGGAGGAAGTGGAGGGGGCGGATCTCAGGTGCAG<br>CTGGTCGAGTCTGGGGGAGGGGTCGTGCAGCCTGGCCGGTCCCTGAGACTGTCTTGCGCCGCCTC<br>CGGCTTCACCTTCATCTCTTACGGCATGCACTGGGTGCGCCAGGCTCCAGGCAAGGGACTGGAAT<br>GGGTGGCCGTGATCTCCTACGACGGCTCCAACAAGTACTACGCCGACTCCGTGAAGGGCCGGTTC<br>ACCATCTCCCGGGACAACTCCAAGAACACCCTGTACCTGCAGATGAACTCCCTGAGGGCCGAGGA<br>CACCGCCGTGTACTACTGTGCCAGGGTGCTGGTCGGCGCTCTGTACTACTACAACTACTACGGCA<br>TGGACGTGTGGGGCCAGGGCACCACCGTGACAGTGTCTTCCGGAGGTGGTGGATCCGAGGTGCAG<br>CTGGTCGAGTCTGGAGGAGGATTGGTGCAGCCTGGAGGGTCATTGAAACTCTCATGTGCAGCCTC |

| SEQ ID NO. | DESIGNATION | SOURCE | TYPE | SEQUENCE |
|---|---|---|---|---|
| | | | | TGGATTCACCTTCAATAAGTACGCCATGAACTGGGTCCGCCAGGCTCCAGGAAAGGGTTTGGAAT GGGTTGCTCGCATAAGAAGTAAATATAATAATTATGCAACATATTATGCCGATTCAGTGAAAGAC AGGTTCACCATCTCCAGAGATGATTCAAAAACACTGCCTATCTACAAATGAACAACTTGAAAAC TGAGGACACTGCCGTGTACTACTGTGTGAGACATGGAACTTCGGTAATAGCTACATATCCTACT GGGCTTACTGGGGCCAAGGGACTCTGGTCACCGTCTCCTCAGGTGGTGGTGGTTCTGGCGGCGGC GGCTCCGGTGGTGGTGGTTCTCAGACTGTTGTGACTCAGGAACCTTCACTCACCGTATCACCTGG TGGAACAGTCACACTCACTTGTGGCCTCGACTGGGGCTGTTACATCTGGCAACTACCCAAACT GGGTCCAACAAAAACCAGGTCAGGCACCCCGTGGTCTAATAGGTGGGACTAAGTTCCTCGCCCCC GGTACTCCTGCCAGATTCTCAGGCTCCCTGCTTGGAGGCAAGGCTGCCCTCACCCTCTCAGGGGT ACAGCCAGAGGATGAGGCAGAATATTACTGTGTTCTATGGTACAGCAACCGCTGGGTGTTCGGTG GAGGAACCAAACTGACTGTCCTA |
| 324. | PSMA P5 L | artificial | aa | AIQLTQSPSSLSASVGDRVTITCRASQGISSALAWYQQKSGKAPKLLIFDASSLESGVPSRFSGS GSGTDFTLTISSLQPEDFATYYCQQFNSYPLTFGGGTKVEIK |
| 325. | PSMA P5 LCDR1 | artificial | aa | RASQGISSALA |
| 326. | PSMA P5 LCDR2 | artificial | aa | DASSLES |
| 327. | PSMA P5 LCDR3 | artificial | aa | QQFNSYPLT |
| 328. | PSMA P5 VL | artificial | nt | GCCATCCAGCTGACCCAGAGTCCCTCCTCCCTGTCTGCCTCCGTGGGCGACAGAGTGACCATCAC CTGCCGGGCCTCCCAGGGCATCTCTTCCGCCCTGGCCTGGTATCAGCAGAAGTCCGGCAAGGCCC CTAAGCTGCTGATCTTCGACGCCTCCTCTCTGGAATCCGGCGTGCCTTCCCGGTTCTCCGGCTCT GGCTCCGGCACCGACTTCACCCTGACCATCTCCAGCCTGCAGCCTGAGGACTTCGCCACCTACTA CTGCCAGCAGTTCAACTCCTACCCTCTGACCTTCGGCGAGGGACCAAGGTGGAGATCAAG |
| 329. | PSMA P5 H | artificial | aa | QVQLVESGGGVVQPGRSLRLSCAASGFTFSSYAMHWVRQAPGKGLEWVAVISYDGNNKYYADSVK GRFTISRDNSKNTLYLQMNSLRAEDTAVYYCARAVPWGSRYYYYGMDVWGQGTTVTVSS |
| 330. | PSMA P5 HCDR1 | artificial | aa | SYAMH |
| 331. | PSMA P5 HCDR2 | artificial | aa | VISYDGNNKYYADSVKG |
| 332. | PSMA P5 HCDR3 | artificial | aa | AVPWGSRYYYYGMDV |
| 333. | PSMA P5 H | artificial | nt | CAGGTGCAGCTGGTCGAGTCTGGGGGAGGGGTCGTGCAGCCTGGCCGGTCCCTGAGACTGTCTTG CGCCGCCTCCGGCTTCACCTTCTCCTACGCCATGCACTGGGTGCGCCAGGCTCCAGGCAAGG GACTGGAATGGGTGGCCGTGATCTCCTACGACGGCAACAACAAGTACTACGCCGACTCCGTGAAG GGCCGGTTCACCATCTCCCGGGACAACTCCAAGAACACCCTGTACCTGCAGATGAACTCCCTGAG GGCTGAGGACACCGCCGTGTACTACTGCGCCAGAGCCGTGCCTTGGGGCTCCCGGTACTACTACT ACGGCATGGACGTGTGGGGCCAGGGCACCACCGTGACAGTGTCTTCC |
| 334. | PSMA P5 LH | artificial | aa | AIQLTQSPSSLSASVGDRVTITCRASQGISSALAWYQQKSGKAPKLLIFDASSLESGVPSRFSGS GSGTDFTLTISSLQPEDFATYYCQQFNSYPLTFGGGTKVEIKGGGGSGGGGSGGGGSQVQLVESG GGVVQPGRSLRLSCAASGFTFSSYAMHWVRQAPGKGLEWVAVISYDGNNKYYADSVKGRFTISRD NSKNTLYLQMNSLRAEDTAVYYCARAVPWGSRYYYYGMDVWGQGTTVTVSS |
| 335. | PSMA P5 LH | artificial | nt | GCCATCCAGCTGACCCAGAGTCCCTCCTCCCTGTCTGCCTCCGTGGGCGACAGAGTGACCATCAC CTGCCGGGCCTCCCAGGGCATCTCTTCCGCCCTGGCCTGGTATCAGCAGAAGTCCGGCAAGGCCC CTAAGCTGCTGATCTTCGACGCCTCCTCTCTGGAATCCGGCGTGCCTTCCCGGTTCTCCGGCTCT GGCTCCGGCACCGACTTCACCCTGACCATCTCCAGCCTGCAGCCTGAGGACTTCGCCACCTACTA CTGCCAGCAGTTCAACTCCTACCCTCTGACCTTCGGCGAGGGACCAAGGTGGAGATCAAGGGCG GAGGGGGCTCTGGCGGCGGAGGAAGTGGAGGGGGCGGATCTCAGGTGCAGCTGGTCGAGTCTGGG GGAGGGGTCGTGCAGCCTGGCCGGTCCCTGAGACTGTCTTGCGCCGCCTCCGGCTTCACCTTCTC CTCTTACGCCATGCACTGGGTGCGCCAGGCTCCAGGCAAGGGACTGGAATGGGTGGCCGTGATCT CCTACGACGGCAACAACAAGTACTACGCCGACTCCGTGAAGGGCCGGTTCACCATCTCCCGGGAC AACTCCAAGAACACCCTGTACCTGCAGATGAACTCCCTGAGGGCTGAGGACACCGCCGTGTACTA CTGCGCCAGAGCCGTGCCTTGGGGCTCCCGGTACTACTACTACGGCATGGACGTGTGGGGCCAGG GCACCACCGTGACAGTGTCTTCC |
| 336. | PSMA P5 LH x I2C HL | artificial | aa | AIQLTQSPSSLSASVGDRVTITCRASQGISSALAWYQQKSGKAPKLLIFDASSLESGVPSRFSGS GSGTDFTLTISSLQPEDFATYYCQQFNSYPLTFGGGTKVEIKGGGGSGGGGSGGGGSQVQLVESG GGVVQPGRSLRLSCAASGFTFSSYAMHWVRQAPGKGLEWVAVISYDGNNKYYADSVKGRFTISRD NSKNTLYLQMNSLRAEDTAVYYCARAVPWGSRYYYYGMDVWGQGTTVTVSSGGGGSEVQLVESGG GLVQPGGSLKLSCAASGFTFNKYAMNWVRQAPGKGLEWVARIRSKYNNYATYYADSVKDRFTISR DDSKNTAYLQMNNLKTEDTAVYYCVRHGNFGNSYISYWAYWGQGTLVTVSSGGGGSGGGGSGGGG SQTVVTQEPSLTVSPGGTVTLTCGSSTGAVTSGNYPNWVQQKPGQAPRGLIGGTKFLAPGTPARF SGSLLGGKAALTLSGVQPEDEAEYYCVLWYSNRWVFGGGTKLTVL |
| 337. | PSMA P5 LH x I2C HL | artificial | nt | GCCATCCAGCTGACCCAGAGTCCCTCCTCCCTGTCTGCCTCCGTGGGCGACAGAGTGACCATCAC CTGCCGGGCCTCCCAGGGCATCTCTTCCGCCCTGGCCTGGTATCAGCAGAAGTCCGGCAAGGCCC CTAAGCTGCTGATCTTCGACGCCTCCTCTCTGGAATCCGGCGTGCCTTCCCGGTTCTCCGGCTCT GGCTCCGGCACCGACTTCACCCTGACCATCTCCAGCCTGCAGCCTGAGGACTTCGCCACCTACTA CTGCCAGCAGTTCAACTCCTACCCTCTGACCTTCGGCGGAGGGACCAAGGTGGAGATCAAGGGCG |

| SEQ ID NO. | DESIGNATION | SOURCE | TYPE | SEQUENCE |
|---|---|---|---|---|
| | | | | GAGGGGGCTCTGGCGGCGGAGGAAGTGGAGGGGGCGGATCTCAGGTGCAGCTGGTCGAGTCTGGG<br>GGAGGGGTCGTGCAGCCTGGCCGGTCCCTGAGACTGTCTTGCGCCGCCTCCGGCTTCACCTTCTC<br>CTCTTACGCCATGCACTGGGTGCGCCAGGCTCCAGGCAAGGGACTGGAATGGGTGGCCGTGATCT<br>CCTACGACGGCAACAACAAGTACTACGCCGACTCCGTGAAGGGCCGGTTCACCATCTCCCGGGAC<br>AACTCCAAGAACACCCTGTACCTGCAGATGAACTCCCTGAGGGCTGAGGACACCGCCGTGTACTA<br>CTGCGCCAGAGCCGTGCCTTGGGGCTCCCGGTACTACTACTACGGCATGGACGTGTGGGGCCAGG<br>GCACCACCGTGACAGTGTCTTCCGGAGGTGGTGGATCCGAGGTGCAGCTGGTCGAGTCTGGAGGA<br>GGATTGGTGCAGCCTGGAGGGTCATTGAAACTCTCATGTGCAGCCTCTGGATTCACCTTCAATAA<br>GTACGCCATGAACTGGGTCCGACCAGGCTCCAGGAAAGGGTTTGGAATGGGTTGCTCGCATAAGAA<br>GTAAATATAATAATTATGCAACATATTATGCCGATTCAGTGAAAGACAGGTTCACCATCTCCAGA<br>GATGATTCAAAAAACACTGCCTATCTACAAATGAACAACTTGAAAACTGAGGACACTGCCGTGTA<br>CTACTGTGTGAGACATGGGAACTTCGGTAATAGCTACATATCCTACTGGGCTTACTGGGGCCAAG<br>GGACTCTGGTCACCGTCTCCTCAGGTGGTGGTGGTTCTGGCGGCGGCGGCTCCGGTGGTGGTGGT<br>TCTCAGACTGTTGTGACTCAGGAACCTTCACTCACCGTATCACCTGGTGGAACAGTCACACTCAC<br>TTGTGGCTCCTCGACTGGGGCTGTTACATCTGGCAACTACCCAAACTGGGTCCAACAAAAACCAG<br>GTCAGGCACCCCGTGGTCTAATAGGTGGGACTAAGTTCCTCGCCCCCGGTACTCCTGCCAGATTC<br>TCAGGCTCCCTGCTTGGAGGCAAGGCTGCCCTCACCCTCTCAGGGGTACAGCCAGAGGATGAGGC<br>AGAATATTACTGTGTTCTATGGTACAGCAACCGCTGGGTGTTCGGTGGAGGAACCAAACTGACTG<br>TCCTA |
| 338. | PSMA D1 L | artificial | aa | EIVLTQSPATLSLSPGERATLSCRASQSVSSYLAWFQQKPGQAPRLLIYDASNRATGIPARFSGS<br>GSGTDFTLTISSLEPEDFAVYYCQQRSNWLMYTFGQGTKLEIK |
| 339. | PSMA D1 LCDR1 | artificial | aa | RASQSVSSYLA |
| 340. | PSMA D1 LCDR2 | artificial | aa | DASNRAT |
| 341. | PSMA D1 LCDR3 | artificial | aa | QQRSNWLMYT |
| 342. | PSMA D1 VL | artificial | nt | GAGATCGTGCTGACCCAGTCCCCTGCCACCCTGTCTCTGTCTCCCGGCGAGAGAGCCACCCTGAG<br>CTGCCGGGCCTCCCAGTCCGTGTCCTCCTACCTGGCCTGGTTCCAGCAGAAGCCTGGACAGGCCC<br>CTAGGCTGCTGATCTACGACGCCTCCAACAGGGCTACCGGCATCCCTGCCCGGTTCTCCGGCTCT<br>GGCTCCGGCACCGACTTCACCCTGACCATCTCCAGCCTGGAACCTGAGGACTTCGCCGTGTACTA<br>CTGCCAGCAGCGGTCCAACTGGCTGATGTATACCTTCGGCCAGGGCACCAAGCTGGAAATCAAG |
| 343. | PSMA D1 H | artificial | aa | EVQLVQSGAEVKKPGESLKISCKGSGYSFTSYWIGWARQMPGKGLEWMGIIYPGDSDTRYSPSFQ<br>GQVTISADKSISTAYLQWSSLKASDTAMYYCSAANSSHWYFDLWGRGTLVTVSS |
| 344. | PSMA D1 HCDR1 | artificial | aa | SYWIG |
| 345. | PSMA D1 HCDR2 | artificial | aa | IIYPGDSDTRYSPSFQG |
| 346. | PSMA D1 HCDR3 | artificial | aa | ANSSHWYFDL |
| 347. | PSMA D1 H | artificial | nt | GAAGTGCAGCTGGTGCAGTCTGGCGCCGAAGTGAAGAAGCCCGGCGAGTCCCTGAAGATCTCCTG<br>CAAGGGCTCCGGGTACTCCTTCACCTCCTACTGGATCGGCTGGGCCAGGCAGATGCCAGGCAAGG<br>GCCTGGAATGGATGGGCATCATCTACCCTGGCGACTCCGACACCCGGTACTCTCCCAGCTTCCAG<br>GGCCAGGTGACCATCTCTGCCGACAAGTCCATCTCCACCGCCTACCTGCAGTGGTCCTCCCTGAA<br>GGCCTCCGACACCGCCATGTACTATTGCTCCGCCGCCAACTCCTCCCACTGGTACTTCGACCTGT<br>GGGGCAGAGGCACCCTGGTGACCGTGTCTTCC |
| 348. | PSMA D1 LH | artificial | aa | EIVLTQSPATLSLSPGERATLSCRASQSVSSYLAWFQQKPGQAPRLLIYDASNRATGIPARFSGS<br>GSGTDFTLTISSLEPEDFAVYYCQQRSNWLMYTFGQGTKLEIKGGGGSGGGGSGGGGSEVQLVQS<br>GAEVKKPGESLKISCKGSGYSFTSYWIGWARQMPGKGLEWMGIIYPGDSDTRYSPSFQGQVTISA<br>DKSISTAYLQWSSLKASDTAMYYCSAANSSHWYFDLWGRGTLVTVSS |
| 349. | PSMA D1 LH | artificial | nt | GAGATCGTGCTGACCCAGTCCCCTGCCACCCTGTCTCTGTCTCCCGGCGAGAGAGCCACCCTGAG<br>CTGCCGGGCCTCCCAGTCCGTGTCCTCCTACCTGGCCTGGTTCCAGCAGAAGCCTGGACAGGCCC<br>CTAGGCTGCTGATCTACGACGCCTCCAACAGGGCTACCGGCATCCCTGCCCGGTTCTCCGGCTCT<br>GGCTCCGGCACCGACTTCACCCTGACCATCTCCAGCCTGGAACCTGAGGACTTCGCCGTGTACTA<br>CTGCCAGCAGCGGTCCAACTGGCTGATGTATACCTTCGGCCAGGGCACCAAGCTGGAAATCAAGG<br>GCGGAGGGGGATCTGGGGGCGGAGGAAGTGGAGGGGGCGGATCCGAAGTGCAGCTGGTGCAGTCT<br>GGCGCCGAAGTGAAGAAGCCCGGCGAGTCCCTGAAGATCTCCTGCAAGGGCTCCGGGTACTCCTT<br>CACCTCCTACTGGATCGGCTGGGCCAGGCAGATGCCAGGCAAGGGCCTGGAATGGATGGGCATCA<br>TCTACCCTGGCGACTCCGACACCCGGTACTCTCCCAGCTTCCAGGGCCAGGTGACCATCTCTGCC<br>GACAAGTCCATCTCCACCGCCTACCTGCAGTGGTCCTCCCTGAAGGCCTCCGACACCGCCATGTA<br>CTATTGCTCCGCCGCCAACTCCTCCCACTGGTACTTCGACCTGTGGGGCAGAGGCACCCTGGTGA<br>CCGTGTCTTCC |
| 350. | PSMA D1 LH x I2C HL | artificial | aa | EIVLTQSPATLSLSPGERATLSCRASQSVSSYLAWFQQKPGQAPRLLIYDASNRATGIPARFSGS<br>GSGTDFTLTISSLEPEDFAVYYCQQRSNWLMYTFGQGTKLEIKGGGGSGGGGSGGGGSEVQLVQS<br>GAEVKKPGESLKISCKGSGYSFTSYWIGWARQMPGKGLEWMGIIYPGDSDTRYSPSFQGQVTISA<br>DKSISTAYLQWSSLKASDTAMYYCSAANSSHWYFDLWGRGTLVTVSSGGGGSEVQLVESGGGLVQ<br>PGGSLKLSCAASGFTFNKYAMNWVRQAPGKGLEWVARIRSKYNNYATYYADSVKDRFTISRDDSK<br>NTAYLQMNNLKTEDTAVYYCVRHGNFGNSYISYWAYWGQGTLVTVSSGGGGSGGGGSGGGGSQTV |

| SEQ ID NO. | DESIGNATION | SOURCE | TYPE | SEQUENCE |
|---|---|---|---|---|
| | | | | VTQEPSLTVSPGGTVTLTCGSSTGAVTSGNYPNWVQQKPGQAPRGLIGGTKFLAPGTPARFSGSL LGGKAALTLSGVQPEDEAEYYCVLWYSNRWVFGGGTKLTVL |
| 351. | PSMA D1 LH x I2C HL | artificial | nt | GAGATCGTGCTGACCCAGTCCCCTGCCACCCTGTCTCTGTCTCCCGGCGAGAGAGCCACCCTGAG CTGCCGGGCCTCCCAGTCCGTGTCCTCCTACCTGGCCTGGTTCCAGCAGAAGCCTGGACAGGCCC CTAGGCTGCTGATCTACGACGCCTCCAACAGGGCTACCGGCATCCCTGCCCGGTTCTCCGGCTCT GGCTCCGGCACCGACTTCACCCTGACCATCTCCAGCCTGGAACCTGAGGACTTCGCCGTGTACTA CTGCCAGCAGCGGTCCAACTGGCTGATGTATACCTTCGGCCAGGGCACCAAGCTGGAAATCAAGG GCGGAGGGGGATCTGGGGGCGGAGGAAGTGGAGGGGGCGGATCCGAAGTGCAGCTGGTGCAGTCT GGCGCCGAAGTGAAGAAGCCCGGCGAGTCCCTGAAGATCTCCTGCAAGGGCTCCGGGTACTCCTT CACCTCCTACTGGATCGGCTGGGCCAGGCAGATGCCAGGCAAGGGCCTGGAATGGATGGGCATCA TCTACCCTGGCGACTCCGACACCCGGTACTCTCCCAGCTTCCAGGGCCAGGTGACCATCTCTGCC GACAAGTCCATCTCCACCGCCTACCTGCAGTGGTCCTCCCTGAAGGCCTCCGACACCGCCATGTA CTATTGCTCCGCCGCCAACTCCTCCCACTGGTACTTCGACCTGTGGGGCAGAGGCACCCTGGTGA CCGTGTCTTCCGGAGGTGGTGGATCCGAGGTGCAGCTGGTCGAGTCTGGAGGAGGATTGGTGCAG CCTGGAGGGTCATTGAAACTCTCATGTGCAGCCTCTGGATTCACCTTCAATAAGTACGCCATGAA CTGGGTCCGCCAGGCTCCAGGAAAGGGTTTGGAATGGGTTGCTCGCATAAGAAGTAAATATAATA ATTATGCAACATATTATGCCGATTCAGTGAAAGACAGGTTCACCATCTCCAGAGATGATTCAAAA AACACTGCCTATCTACAAATGAACAACTTGAAAACTGAGGACACTGCCGTGTACTACTGTGTGAG ACATGGGAACTTCGGTAATAGCTACATATCCTACTGGGCTTACTGGGGCCAAGGGACTCTGGTCA CCGTCTCCTCAGGTGGTGGTGGTTCTGGCGGCGGCGGCTCCGGTGGTGGTGGTTCTCAGACTGTT GTGACTCAGGAACCTTCACTCACCGTATCACCTGGTGGAACAGTCACACTCACTTGTCGGCTCCTC GACTGGGGCTGTTACATCTGGCAACTACCCAAACTGGGTCCAACAAAAACCAGGTCAGGCACCCC GTGGTCTAATAGGTGGGACTAAGTTCCTCGCCCCCGGTACTCCTGCCAGATTCTCAGGCTCCCTG CTTGGAGGCAAGGCTGCCCTCACCCTCTCAGGGGTACAGCCAGAGGATGAGGCAGAATATTACTG TGTTCTATGGTACAGCAACCGCTGGGTGTTCGGTGGAGGAACCAAACTGACTGTCCTA |
| 352. | PSMA D2 L | artificial | aa | EIVLTQSPATLSLSPGERATLSCRASQSVSSYLAWYQQKPGQAPRLLIYDASNRATGIPARFSGS GSGTDFTLTISSLEPEDFAVYYCQQRSDWLMYTFGQGTKLEIK |
| 353. | PSMA D2 LCDR1 | artificial | aa | RASQSVSSYLA |
| 354. | PSMA D2 LCDR2 | artificial | aa | DASNRAT |
| 355. | PSMA D2 LCDR3 | artificial | aa | QQRSDWLMYT |
| 356. | PSMA D2 VL | artificial | nt | GAGATCGTGCTGACCCAGTCCCCTGCCACCCTGTCTCTGTCTCCCGGCGAGAGAGCCACCCTGAG CTGCCGGGCCTCCCAGTCCGTGTCCTCCTACCTGGCCTGGTATCAGCAGAAGCCTGGACAGGCCC CTAGGCTGCTGATCTACGACGCCTCCAACAGGGCTACCGGCATCCCTGCCCGGTTCTCCGGCTCT GGCTCCGGCACCGACTTCACCCTGACCATCTCCAGCCTGGAACCTGAGGACTTCGCCGTGTACTA CTGCCAGCAGCGGTCCGACTGGCTGATGTATACCTTCGGCCAGGGCACCAAGCTGGAAATCAAG |
| 357. | PSMA D2 H | artificial | aa | EVQLVQSGAEVKTPGESLKISCKGSGYTFTSYWIGWVRQMPGKGPEWMGIIYPGDSDTRYSPSFQ GQVTFSADKSISTAYLQWNSLKTSDTAMYYCATANPSYWYFDLWGRGTLVTVSS |
| 358. | PSMA D2 HCDR1 | artificial | aa | SYWIG |
| 359. | PSMA D2 HCDR2 | artificial | aa | IIYPGDSDTRYSPSFQG |
| 360. | PSMA D2 HCDR3 | artificial | aa | ANPSYWYFDL |
| 361. | PSMA D2 H | artificial | nt | GAAGTGCAGCTGGTGCAGTCTGGCGCCGAAGTGAAAACCCCTGGCGAGTCCCTGAAGATCTCCTG CAAGGGCTCCGGCTACACCTTCACCTCTTACTGGATCGGCTGGGTGCGCCAGATGCCTGGCAAGG GCCCTGAGTGGATGGGCATCATCTACCCTGGCGACTCCGACACCCGGTACTCTCCCAGCTTCCAG GGCCAGGTGACCTTCTCCGCCGACAAGTCCATCTCCACCGCCTACCTGCAGTGGAACTCCCTGAA AACCTCCGACACCGCCATGTACTATTGCGCCACCGCCAACCCTAGCTACTGGTACTTCGACCTGT GGGGCAGAGGCACCCTGGTGACCGTGTCTTCC |
| 362. | PSMA D2 LH | artificial | aa | EIVLTQSPATLSLSPGERATLSCRASQSVSSYLAWYQQKPGQAPRLLIYDASNRATGIPARFSGS GSGTDFTLTISSLEPEDFAVYYCQQRSDWLMYTFGQGTKLEIKGGGGSGGGGSGGGGSEVQLVQS GAEVKTPGESLKISCKGSGYTFTSYWIGWVRQMPGKGPEWMGIIYPGDSDTRYSPSFQGQVTFSA DKSISTAYLQWNSLKTSDTAMYYCATANPSYWYFDLWGRGTLVTVSS |
| 363. | PSMA D2 LH | artificial | nt | GAGATCGTGCTGACCCAGTCCCCTGCCACCCTGTCTCTGTCTCCCGGCGAGAGAGCCACCCTGAG CTGCCGGGCCTCCCAGTCCGTGTCCTCCTACCTGGCCTGGTATCAGCAGAAGCCTGGACAGGCCC CTAGGCTGCTGATCTACGACGCCTCCAACAGGGCTACCGGCATCCCTGCCCGGTTCTCCGGCTCT GGCTCCGGCACCGACTTCACCCTGACCATCTCCAGCCTGGAACCTGAGGACTTCGCCGTGTACTA CTGCCAGCAGCGGTCCGACTGGCTGATGTATACCTTCGGCCAGGGCACCAAGCTGGAAATCAAGG GCGGAGGGGGATCTGGCGGCGGAGGAAGTGGAGGGGGCGGATCCGAAGTGCAGCTGGTGCAGTCT GGCGCCGAAGTGAAAACCCCTGGCGAGTCCCTGAAGATCTCCTGCAAGGGCTCCGGCTACACCTT CACCTCTTACTGGATCGGCTGGGTGCGCCAGATGCCTGGCAAGGGCCCTGAGTGGATGGGCATCA TCTACCCTGGCGACTCCGACACCCGGTACTCTCCCAGCTTCCAGGGCCAGGTGACCTTCTCCGCC GACAAGTCCATCTCCACCGCCTACCTGCAGTGGAACTCCCTGAAAACCTCCGACACCGCCATGTA CTATTGCGCCACCGCCAACCCTAGCTACTGGTACTTCGACCTGTGGGGCAGAGGCACCCTGGTGA CCGTGTCTTCC |

-continued

| SEQ ID NO. | DESIGNATION | SOURCE | TYPE | SEQUENCE |
|---|---|---|---|---|
| 364. | PSMA D2 LH x I2C HL | artificial | aa | EIVLTQSPATLSLSPGERATLSCRASQSVSSYLAWYQQKPGQAPRLLIYDASNRATGIPARFSGS GSGTDFTLTISSLEPEDFAVYYCQQRSDWLMYTFGQGTKLEIKGGGGSGGGGSGGGGSEVQLVQS GAEVKTPGESLKISCKGSGYTFTSYWIGWVRQMPGKGPEWMGIIYPGDSDTRYSPSFQGQVTFSA DKSISTAYLQWNSLKTSDTAMYYCATANPSYWYFDLWGRGTLVTVSSGGGGSEVQLVESGGGLVQ PGGSLKLSCAASGFTFNKYAMNWVRQAPGKGLEWVARIRSKYNNYATYYADSVKDRFTISRDDSK NTAYLQMNNLKTEDTAVYYCVRHGNFGNSYISYWAYWGQGTLVTVSSGGGGSGGGGSGGGGSQTV VTQEPSLTVSPGGTVTLTCGSSTGAVTSGNYPNWVQQKPGQAPRGLIGGTKFLAPGTPARFSGSL LGGKAALTLSGVQPEDEAEYYCVLWYSNRWVFGGGTKLTVL |
| 365. | PSMA D2 LH x I2C HL | artificial | nt | GAGATCGTGCTGACCCAGTCCCCTGCCACCCTGTCTCTGTCTCCCGGCGAGAGAGCCACCCTGAG CTGCCGGGCCTCCCAGTCCGTGTCCTCCTACCTGGCCTGGTATCAGCAGAAGCCTGGACAGGCCC CTAGGCTGCTGATCTACGACGCCTCCAACAGGGCTACCGGCATCCCTGCCCGGTTCTCCGGCTCT GGCTCCGGCACCGACTTCACCCTGACCATCTCCAGCCTGGAACCTGAGGACTTCGCCGTGTACTA CTGCCAGCAGCGGTCCGACTGGCTGATGTATACCTTCGGCCAGGGCACCAAGCTGGAAATCAAGG GCGGAGGGGGATCTGGCGGCGGAGGAAGTGGAGGGGGCGGATCCGAAGTGCAGCTGGTGCAGTCT GGCGCCGAAGTGAAAACCCCTGGCGAGTCCCTGAAGATCTCCTGCAAGGGCTCCGGCTACACCTT CACCTCTTACTGGATCGGCTGGGTGCGCCAGATGCCTGGCAAGGGCCCTGAGTGGATGGGCATCA TCTACCCTGGCGACTCCGACACCCGGTACTCTCCCAGCTTCCAGGGCCAGGTGACCTTCTCCGCC GACAAGTCCATCTCCACCGCCTACCTGCAGTGGAACTCCCTGAAAACCTCCGACACCGCCATGTA CTATTGCGCCACCGCCAACCCTAGCTACTGGTACTTCGACCTGTGGGGCAGAGGCACCCTGGTGA CCGTGTCTTCCGGAGGTGGTGGATCCGGAGGTGCAGCTGGTGAGTCTGGAGGAGGATTGGTGCAG CCTGGAGGGTCATTGAAACTCTCATGTGCAGCCTCTGGATTCACCTTCAATAAGTACGCCATGAA CTGGGTCCGCCAGGCTCCAGGAAAGGGTTTGGAATGGGTTGCTCGCATAAGAAGTAAATATAATA ATTATGCAACATATTATGCCGATTCAGTGAAAGACAGGTTCACCATCTCCAGAGATGATTCAAAA AACACTGCTATCTACAAATGAACAACTTGAAAACTGAGGACACTGCCGTGTACTACTGTGTGAG ACATGGGAACTTCGGTAATAGCTACATATCCTACTGGGCTTACTGGGGCCAAGGGACTCTGGTCA CCGTCTCCTCAGGTGGTGGTGGTTCTGGCGGCGGCGGCTCCGGTGGTGGTGGTTCTCAGACTGTT GTGACTCAGGAACCTTCACTCACCGTATCACCTGGTGGAACAGTCACACTCACTTGTGGCTCCTC GACTGGGGCTGTTACATCTGGCAACTACCCAAACTGGGTCCAACAAAAACCAGGTCAGGCACCCC GTGGTCTAATAGGTGGGACTAAGTTCCTCGCCCCCGGTACTCCTGCCAGATTCTCAGGCTCCCTG CTTGGAGGCAAGGCTGCCCTCACCCTCTCAGGGGTACAGCCAGAGGATGAGGCAGAATATTACTG TGTTCTATGGTACAGCAACCGCTGGGTGTTCGGTGGAGGAACCAAACTGACTGTCCTA |
| 366. | human FAPα construct | artificial | nt | ATGAAGACTTGGGTAAAAATCGTATTTGGAGTTGCCACCTCTGCTGTGCTTGCCTTATTGGTGAT GTGCATTGTCTTACGCCCTTCAAGAGTTCATAACTCTGAAGAAAATACAATGAGAGCACTCACAC TGAAGGATATTTTAAATGGAACATTTTCTTATAAAACATTTTTTCCAAACTGGATTTCAGGACAA GAATATCTTCATCAATCTGCAGATAACAATATAGTACTTATAATATTGAAACAGGACAATCATA TACCATTTTGAGTAATAGAACCATGAAAAGTGTGAATGCTTCAAATTACGGCTTATCACCTGATC GGCAATTTGTATATCTAGAAAGTGATTATTCAAAGCTTTGGAGATACTCTTACACAGCAACATAT TACATCTATGACCTTAGCAATGGAGAATTTGTAAGAGGAAATGAGCTTCCTCGTCCAATTCAGTA TTTTATGCTGGTCGCCTGTTGGGAGTAAATTAGCATATGTCTATCAAAACAATATCTATTTGAAAC AAAGACCAGGAGATCCACCTTTTCAAATAACATTTAATGGAAGAGAAAATAAAATATTTAATGGA ATCCCAGACTGGGTTTATGAAGAGGAAATGCTTGCTACAAAATATGCTCTCTGGTGGTCTCCTAA TGGAAAATTTTTGGCATATGCGGAATTTAATGATACGGATATACCAGTTATTGCCTATTCCTATT ATGGCGATGAACAATATCCTAGAACAATAAATATTCCATACCCAAAGGCTGGAGCTAAGAATCCC GTTGTTCGGATATTTATTATCGATACCCACTTACCCTGCGTATGTAGGTACCCCAGGAAGTGCCTGT TCCAGCAATGATAGCCTCAAGTGATTATTATTTCAGTTGGCTCACGTGGGTTACTGATGAACGAG TATGTTTGCAGTGGCTAAAAAGAGTCCAGAATGTTTCGGTCCTGTCTATATGTGACTTCAGGGAA GACTGGCAGACATGGGATTGTCCAAAGACCCAGGAGCATATAGAAGAAAGCAGAACTGGATGGGC TGGTGGATTCTTTGTTTCAACACCAGTTTTCAGCTATGATGCCATTTCGTACTACAAAATATTTA GTGACAAGGATGGCTACAAACATATTCACTATATCAAAGACACTGTGGAAAATGCTATTCAAATT ACAAGTGGCAAGTGGGAGGCCATAAATATATTCAGAGTAACACAGGATTCACTGTTTTATTCTAG CAATGAATTTGAAGAATACCCTGGAAGAAGAAACATCTACAGAATTAGCATTGGAAGCTATCCTC CAAGCAAGAAGTGTGTTACTTGCCATCTAAGGAAGAAAAGGTGCCAATATTACACAGCAAGTTTC AGCGACTACGCCAAGTACTATGCACTTGTCTGCTACGGCCCAGGCATCCCCATTTCCACCCTTCA TGATGGACGCACTGATCAAGAATTAAAATCCTGGAAGAAAACAAGGAATTGGAAAATGCTTTGA AAAATATCCAGCTGCCTAAAGAGGAAATTAAGAAACTTGAAGTAGATGAAATTACTTTATGGTAC AAGATGATTCTTCCTCCTCAATTTGACAGATCAAAGAAGTATCCCTTGCTAATTCAAGTGTATGG TGGTCCCTGCAGTCAGAGTGTAAGGTCTGTATTTGCTGTTAATTGGATATCTTATCTTGCAAGTA AGGAAGGGATGGTCATTGCCTTGGTGGATGGTCGAGGAACAGCTTTCCAAGGTGACAAACTCCTC TATGCAGTGTATCGAAAGCTGGGTGTTTATGAAGTTGAAGACCAGATTACAGCTGTCAGAAAATT CATAGAAATGGGTTTCATTGATGAAAAAAGAATAGCCATATGGGGCTGGTCCTATGGAGGATACG TTTCATCACTGGCCCTGGCATCTGGAACTGGTCTTTTCAAATGTGGTATAGCAGTGGCTCCAGTC TCCAGCTGGGAATATTACGCGTCTGTCTACACAGAGAGATTCATGGGTCTCCCAACAAAGGATGA TAATCTTGAGCACTATAAGAATTCAACTGTGATGGCAAGAGCAGATATTTCAGAAATGTAGACT ATCTTCTCATCCACGGAACAGCAGATGATAATGTGCACTTTCAAAACTCAGCACAGATTGCTAAA GCTCTGGTTAATGCACAAGTGGATTTCCAGGCAATGTGGTACTCTGACCAGAACCACGGCTTATC CGGCCTGTCCACGAACCACTTATACACCCACATGACCCACTTCCTAAAGCAGTGTTTCTCTTTGT CAGACTAA |
| 367. | human FAPα construct | artificial | aa | MKTWVKIVFGVATSAVLALLVMCIVLRPSRVHNSEENTMRALTLKDILNGTFSYKTFFPNWISGQ EYLHQSADNNIVLYNIETGQSYTILSNRTMKSVNASNYGLSPDRQFVYLESDYSKLWRYSYTATY YIYDLSNGEFVRGNELPRPIQYLCWSPVGSKLAYVYQNNIYLKQRPGDPPFQITFNGRENKIFNG IPDWVYEEEMLATKYALWWSPNGKFLAYAEFNDTDIPVIAYSYYGDEQYPRTINIPYPKAGAKNP |

| SEQ ID NO. | DESIGNATION | SOURCE | TYPE | SEQUENCE |
|---|---|---|---|---|
| | | | | VVRIFIIDTTYPAYVGPQEVPVPAMIASSDYYFSWLTWVTDERVCLQWLKRVQNVSVLSICDFRE DWQTWDCPKTQEHIEESRTGWAGGFFVSTPVFSYDAISYYKIFSDKDGYKHIHYIKDTVENAIQI TSGKWEAINIFRVTQDSLFYSSNEFEEYPGRRNIYRISIGSYPPSKKCVTCHLRKERCQYYTASF SDYAKYYALVCYGPGIPISTLHDGRTDQEIKILEENKELENALKNIQLPKEEIKKLEVDEITLWY KMILPPQFDRSKKYPLLIQVYGGPCSQSVRSVFAVNWISYLASKEGMVIALVDGRGTAFQGDKLL YAVVRKLGVYEVEDQITAVRKFIEMGFIDEKRIAIWGWSYGGYVSSLALASGTGLFKCGIAVAPV SSWEYYASVYTERFMGLPTKDDNLEHYKNSTVMARAEYFRNVDYLLIHGTADDNVHFQNSAQIAK ALVNAQVDFQAMWYSDQNHGLSGLSTNHLYTHMTHFLKQCFSLSD |
| 368. | soluble fusion protein of h FAPα and m Lag3 | artificial | nt | ATGAGGGAGGACCTGCTCCTTGGCTTTTTGCTTCTGGGACTGCTTTGGGAAGCTCCAGTTGTGTC TTCAGGGCCTGGGAAAGAGCTCCCCGTGGTGTGGGCCCAGGAGGGAGCTCCCGTCCATCTTCCCT GCAGCCTCAAATCCCCCAACCTGGATCCTAACTTTCTACGAAGAGGAGGGGTTATCTGGCAACAT CAACCAGACAGTGGCCAACCCACTCCCATCCCGGCCCTTGACCTTCACCAGGGGATGCCCTCGC TAGACAACCCGCACCCGGTCGCTGCCTGAGCGTGGCTCCAGGAGGCCTGCGCAGCGGGA GGCAGCCCTGCATCCCCACGTGCAGCTGGAGGAGCGCGGCCTCCAGCGCGGGGACTTCTCTCTG TGGTTGCGCCCAGCTCTGCGCACCGATGCGGGCGAGTACCACGCCACCGTGCGCCTCCCGAACCG CGCCCTCTCCTGCAGTCTCCGCCTGCGCGTCGGCCAGGCCTCGATGATTGCTAGTCCCTCAGGAG TCCTCAAGCTGTCTGATTGGGTCCTTTTGAACTGCTCCTTCAGCCGTCCTGACCGCCCAGTCTCT GTGCACTGGTTCCAGGGCCAGAACCGAGTGCCTGTCTACAACTCACCGCGTCATTTTTTAGCTGA AACTTTCCTGTTACTGCCCCAAGTCAGCCCCCTGGACTCTGGGACCTGGGGCTGTGTCCTCACCT ACAGAGATGGCTTCAATGTCTCCATCACGTACAACCTCAAGGTTCTGGGTCTGGAGCCCGTAGCC CCTCTGACAGTGTACGCTGCCTGAAGGTTCTAGGGTGGAGCTGCCCTGTCATTTGCCCCCAGGAGT GGGGACCCCTTCTTTGCTCATTGCCAAGTGGACTCCTCCTGGAGGAGGTCCTGAGCTCCCGTGG CTGGAAAGAGTGGCAATTTTACCCTTCACCTTGAGGCTGTGGGTCTGGCACAGGCTGGGACCTAC ACCTGTAGCATCCATCTGCAGGGACAGCAGCTCAATGCCACTGTCACGTTGGCGGTCATCACAGT GACTCCCAAATCCTTCGGGTTACCTGGCTCCCGGGGGAAGCTGTTGTGTGAGGTAACCCCGGCAT CTGGAAAGGAAAGATTTGTGTGGCGTCCCCTGAACAATCTGTCCAGGAGTTGCCCGGGCCTGTG CTGGAGATTCAGGAGGCCAGGCTCCTTGCTGAGCGATGGCAGTGTCAGCTGTACGAGGGCCAGAG GCTTCTTGGAGCGACAGTGTACGCCGCAGAGTCTAGCTCAGGCGCCCACAGTGCTAGGAGAATCT CAGGTGACCTTAAAGGAGGCCATTCCGGAGGTGGTGGATCCCGCCCTTCAAGAGTTCATAACTCT GAAGAAATACAATGAGAGCACTCACACTGAAGGATATTTTAAATGGAACATTTTCTTATAAAAC ATTTTTTCCAAACTGGATTTCAGGACAAGAATATCTTCATCAATCTGCAGATAACAATATAGTAC TTTATAATATTGAAACAGGACAATCATATACCATTTTGAGTAATAGAACCATGAAAAGTGTGAAT GCTTCAAATTACGGCTTATCACCTGATCGGCAATTTGTATATCTAGAAAGTGATTATTCAAAGCT TTGGAGATACTCTTACACAGCAACATATTACATCTATGACCTTAGCAATGGAGAATTTGTAAGAG GAAATGAGCTTCCTCGTCCAATTCAGTATTTATGCTGGTCGCCTGTTGGGAGTAAATTAGCATAT GTCTATCAAAACAATATCTATTTGAAACAAGACCAGGAGATCCACCTTTTCAAATAACATTTAA TGGAAGAGAAAATAAAATATTTAATGGAATCCCAGACTGGGTTTATGAAGAGGAAATGCTTGCTA CAAAATATGCTCTCTGGTGGTCTCCTAATGGAAAATTTTTGGCATATGCGGAATTTAATGATACG GATATACCAGTTATTGCCTATTCCTATTATGGCGATGAACAATATCCTAGAACAATAAATATTCC ATACCCAAAGGCTGGAGCTAAGAATCCCGTTGTTCGGATATTTATTATCGATACCACTTACCCTG CGTATGTAGGTCCCCAGGAAGTGCCTGTTCCAGCAATGATAGCCTCAAGTGATTATTATTTCAGT TGGCTCACGTGGGTTACTGATGAACGAGTATGTTTGCAGTGGCTAAAAAGAGTCCAGAATGTTTC GGTCCTGTCTATATGTGACTTCAGGGAAGACTGGCAGACATGGGATTGTCCAAAGACCCAGGAGC ATATAGAAGAAAGCAGAACTGGATGGGCTGGTGGATTCTTTGTTTCAACACCAGTTTTCAGCTAT GATGCCATTTCGTACTACAAATATTTAGTGACAAGGATGGCTACAAACATATTCACTATATCAA AGACACTGTGGAAATGCTATTCAAATTACAAGTGGCAAGTGGGAGGCCATAAATATATTCAGAG TAACACAGGATTCACTGTTTTATTCTAGCAATGAATTTGAAGAATACCCTGGAAGAAGAAACATC TACAGAATTAGCATTGGAAGCTATCCTCCAAGCAAGAAGTGTGTTACTTGCCATCTAAGGAAAGA AAGGTGCCAATATTACACAGCAAGTTTCAGCGACTACGCCAAGTACTATGCACTTGTCTGCTACG GCCCAGGCATCCCCATTTCCACCCTTCATGATGGACGCACTGATCAAGAAATTAAAATCCTGGAA GAAAACAAGGAATTGGAAAATGCTTTGAAAAATATCCAGCTGCCTAAAGAGGAAATTAAGAAACT TGAAGTAGATGAAATTACTTTATGGTACAAGATGATTCTTCCTCCTCAATTTGACAGATCAAAGA AGTATCCCTTGCTAATTCAAGTGTATGGTGGTCCCTGCAGTCAGAGTGTAAGGTCTGTATTTGCT GTTAATTGGATATCTTATCTTGCAAGTAAGGAAGGGATGGTCATTGCCTTGGTGGATGGTCGAGG AACAGCTTTCCAAGGTGACAAACTCCTCTATGCAGTGTATCGAAAGCTGGGTGTTTATGAAGTTG AAGACCAGATTACAGCTGTCAGAAAATTCATAGAAATGGGTTTCATTGATGAAAAAGAATAGCC ATATGGGGCTGGTCCTATGGAGGATACGTTTCATCACTGGCCCTTGCATCTGGAACTGGTCTTTT CAAATGTGGTATAGCAGTGGCTCCAGTCTCCAGCTGGGAATATTACGCGTTCTGTCTACACAGAGA GATTCATGGGTCTCCCAACAAAGGATGATAATCTTGAGCACTATAAGAATTCAACTGTGATGGCA AGAGCAGAATATTTCAGAAATGTAGACTATCTTCTCATCCACGGAACAGCAGATGATAATGTGCA CTTTCAAAACTCAGCACAGATTGCTAAAGCTCTGGTTAATGCACAAGTGGATTTCCAGGCAATGT GGTACTCTGACCAGAACCACGGCTTATCCGGCCTGTCCACGAACCACTTATACACCCACATGACC CACTTCCTAAAGCAGTGTTTCTCTTTGTCAGACTCCGGGCATCATCACCATCATCATTGA |
| 369. | soluble fusion protein of h FAPα and m Lag3 | artificial | aa | MREDLLLGFLLLGLLWEAPVVSSGPGKELPVVWAQEGAPVHLPCSLKSPNLDPNFLRRGGVIWQH QPDSGQPTPIPALDLHQGMPSPRQPAPGRYTVLSVAPGGLRSGRQPLHPVQLEERGLQRGDFSL WLRPALRTDAGEYHATVRLPNRALSCSLRLRVGQASMIASPSGVLKLSDWVLLNCSFSRPDRPVS VHWFQGQNRVPVYNSPRHFLAETFLLLPQVSPLDSGTWGCVLTYRDGFNVSITYNLKVLGLEPVA PLTVYAAEGSRVELPCHLPPGVGTPSLLIAKWTPGGGPELPVAGKSGNFTLHLEAVGLAQAGTY TCSIHLQGQQLNATVTLAVITVTPKSFGLPGSRGKLLCEVTPASGKERFVWRPLNNLSRSCPGPV LEIQEARLLAERWQCQLYEGQRLLGATVYAAESSSGAHSARRISGDLKGGHSGGGGSRPSVHNS EENTMRALTLKDILNGTFSYKTFFPNWISGQEYLHQSADNNIVLYNIETGQSYTILSNRTMKSVN ASNYGLSPDRQFVYLESDYSKLWRYSYTATYYIYDLSNGEFVRGNELPRPIQYLCWSPVGSKLAY VYQNNIYLKQRPGDPPFQITFNGRENKIFNGIPDWVYEEEMLATKYALWWSPNGKFLAYAEFNDT |

| SEQ ID NO. | DESIGNATION | SOURCE | TYPE | SEQUENCE |
|---|---|---|---|---|
| | | | | DIPVIAYSYYGDEQYPRTINIPYPKAGAKNPVVRIFIIDTTYPAYVGPQEVPVPAMIASSDYYFS<br>WLTWVTDERVCLQWLKRVQNVSVLSICDFREDWQTWDCPKTQEHIEESRTGWAGGFFVSTPVFSY<br>DAISYYKIFSDKDGYKHIHYIKDTVENAIQITSGKWEAINIFRVTQDSLFYSSNEFEEYPGRRNI<br>YRISIGSYPPSKKCVTCHLRKERCQYYTASFSDYAKYYALVCYGPGIPISTLHDGRTDQEIKILE<br>ENKELENALKNIQLPKEEIKKLEVDEITLWYKMILPPQFDRSKKYPLLIQVYGGPCSQSVRSVFA<br>VNWISYLASKEGMVIALVDGRGTAFQGDKLLYAVYRKLGVYEVEDQITAVRKFIEMGFIDEKRIA<br>IWGWSYGGYVSSLALASGTGLFKCGIAVAPVSSWEYYASVYTERFMGLPTKDDNLEHYKNSTVMA<br>RAEYFRNVDYLLIHGTADDNVHFQNSAQIAKALVNAQVDFQAMWYSDQNHGLSGLSTNHLYTHMT<br>HFLKQCFSLSDSGHHHHHH |
| 370. | murine FAPα construct | artificial | nt | ATGAAGACATGGCTGAAAACTGTCTTTGGAGTTACCACCCTGGCTGCGCTTGCTTTAGTGGTGAT<br>ATGCATTGTCTTACGTCCCTCAAGAGTTTACAAACCTGAAGGAAACACAAAGAGAGCTCTTACCT<br>GAAGGATATTTTAAATGGAACATTCTCATATAAAACATATTTTCCCAACTGGATTTCAGAACAA<br>GAATATCTTCATCAATCTGAGGATGATAACATAGTATTTTATAATATTGAAACAAGAGAATCATA<br>TATCATTTTGAGTAATAGCACCATGAAAAGTGTGAATGCTACAGATTATGGTTTGTCACCTGATC<br>GGCAATTTGTGTATCTAGAAAGTGATTATTCAAAGCTCTGGCGATATTCATACACAGCGACATAC<br>TACATCTACGACCTTCAGAATGGGGAATTTGTAAGAGGATACGAGCTCCCTCGTCCAATTCAGTA<br>TCTATGCTGGTCGCCTGTTGGGAGTAAATTAGCATATGTATATCAAAACAATATTTATTTGAAAC<br>AAAGACCAGGAGATCCACCTTTTCAAATAACTTATACTGGAAGAGAAAATAGAATATTTAATGGA<br>ATACCAGACTGGGTTTATGAAGAGGAAATGCTTGCCACAAAATATGCTCTTTGGTGGTCTCCAGA<br>TGGAAAATTTTGGCATATGTAGAATTTAATGATTCAGATATACCAATTATTGCCTATTCTTATT<br>ATGGTGATGGACAGTATCCTAGAACTATAAATATTCCATATCCAAAGGCTGGGGCTAAGAATCCG<br>GTTGTTCGTGTTTTATTGTTGACACCACCTACCCTCACCACGTGGGCCCAATGGAAGTGCCAGT<br>TCCAGAAATGATAGCCTCAAGTGACTATTATTTCAGCTGGCTCACATGGGTGTCCAGTGAACGAG<br>TATGCTTGCAGTGGCTAAAAGAGTGCAGAATGTCTCAGTCCTGTCTATATGTGATTTCAGGGAA<br>GACTGGCATGCATGGGAATGTCCAAAGAACCAGGAGCATGTAGAAGAAAGCAGAACAGGATGGGC<br>TGGTGGATTCTTTGTTTCGACACCAGCTTTTAGCCAGGATGCCACTTCTTACTACAAAATATTTA<br>GCGACAAGGATGGTTACAAACATATTCACTACATCAAAGACACTGTGGAAAATGCTATTCAAATT<br>ACAAGTGGCAAGTGGGAGGCCATATATATATTCCGCGTAACACAGGATTCACTGTTTTATTCTAG<br>CAATGAATTTGAAGGTTACCCTGGAAGAAGAAACATCTACAGAATTAGCATTGGAAACTCTCCTC<br>CGAGCAAGAAGTGTGTTACTTGCCATCTAAGGAAAGAAAGGTGCCAATATTACACAGCAAGTTTC<br>AGCTACAAAGCCAAGTACTATGCACTCGTCTGCTATGGCCCTGGCCTCCCCATTTCCACCCTCCA<br>TGATGGCCGCACAGACCAAGAAATACAAGTATTAGAAGAAAACAAAGAACTGGAAAATTCTCTGA<br>GAAATATCCAGCTGCCTAAAGTGGAGATTAAGAAGCTCAAAGACGGGGACTGACTTTCTGGTAC<br>AAGATGATTCTGCCTCCTCAGTTTGACAGATCAAAGAAGTACCCTTTGCTAATTCAAGTGTATGG<br>TGGTCCTTGTAGCCAGAGTGTTAAGTCTGTGTTTGCTGTTAATTGGATAACTTATCTCGCAAGTA<br>AGGAGGGGATAGTCATTGCCCTGGTAGATGGTCGGGGCACTGCTTTCCAAGGTGACAAATTCCTG<br>CATGCCGTGTATCGCAAAACTGGGTGTATATGAAGTTGAGGACCAGCTCACAGCTGTCAGAAATT<br>CATAGAAATGGGTTCATTGATGAAGAAAGAATAGCCATATGGGGCTGGTCCTACGGAGGTTATG<br>TTTCATCCCTGGCCCTTGCATCTGGAACTGGTCTTTTCAAATGTGGCATAGCAGTGGCTCCAGTC<br>TCCAGCTGGGAATATTACGCATCTATCTACTCAGAGAGATTCATGGGCCTCCCAACAAAGGACGA<br>CAATCTCGAACACTATAAAAATTCAACTGTGATGGCAAGAGCAGAATATTTCAGAAATGTAGACT<br>ATCTTCTCATCCACGGAACAGCAGATGATAATGTGCACTTTCAGAACTCAGCACAGATTGCTAAA<br>GCTTTGGTTAATGCACAAGTGGATTTCCAGGCGATGTGGTACTCTGACCAGAACCATGGTATATC<br>ATCTGGGCGCTCCCAGAATCATTTATATACCCACATGACGCACTTCCTCAAGCAATGCTTTTCTT<br>TATCAGACGATTACAAGGACGACGATGACAAGTGA |
| 371. | murine FAPα construct | artificial | aa | MKTWLKTVFGVTTLAALAVVICIVLRPSRVYKPEGNTKRALTLKDILNGTFSYKTYFPNWISEQ<br>EYLHQSEDDNIVFYNIETRESYIILSNSTMKSVNATDYGLSPDRQFVYLESDYSKLWRYSYTATY<br>YIYDLQNGEFVRGYELPRPIQYLCWSPVGSKLAYVYQNNIYLKQRPGDPPFQITYTGRENRIFNG<br>IPDWVYEEEMLATKYALWWSPDGKFLAYVEFNDSDIPIIAYSYYGDGQYPRTINIPYPKAGAKNP<br>VVRVFIVDTTYPHHVGPMEVPVPEMIASSDYYFSWLTWVSSERVCLQWLKRVQNVSVLSICDFRE<br>DWHAWECPKNQEHVEESRTGWAGGGFFVSTPAFSQDATSYYKIFSDKDGYKHIHYIKDTVENAIQI<br>TSGKWEAIYIFRVTQDSLFYSSNEFEGYPGRRNIYRISIGNSPPSKKCVTCHLRKERCQYYTASF<br>SYKAKYYALVCYGPGLPISTLHDGRTDQEIQVLEENKELENSLRNIQLPKVEIKKLKDGGLTFWY<br>KMILPPQFDRSKKYPLLIQVYGGPCSQSVKSVFAVNWITYLASKEGIVIALVDGRGTAFQGDKFL<br>HAVYRKLGVYEVEDQLTAVRKFIEMGFIDEERIAIWGWSYGGYVSSLALASGTGLFKCGIAVAPV<br>SSWEYYASIYSERFMGLPTKDDNLEHYKNSTVMARAEYFRNVDYLLIHGTADDNVHFQNSAQIAK<br>ALVNAQVDFQAMWYSDQNHGISSGRSQNHLYTHMTHFLKQCFSLSDDYKDDDDK |
| 372. | mutated human FAPα antigen | artificial | nt | ATGAAGACTTGGGTAAAAATCGTATTTGGAGTTGCCACCTCTGCTGTGCTTGCCTTATTGGTGAT<br>GTGCATTGTCTTACGCCCTTCAAGAGTTCATAACTCTGAAGAAAATACAATGAGAGCACTCACAC<br>TGAAGGATATTTTAAATGGAACATTTTCTTATAAAACATTTTTTCCAAACTGGATTTCAGGACAA<br>GAATATCTTCATCAATCTGCAGATAACATAGTACTTTATAATATTGAAACAGGACAATCATA<br>TACCATTTTGAGTAATAGAACCATGAAAAGTGTGAATGCTTCAAATTACGGCTTATCACCTGATC<br>GGCAATTTGTATATCTAGAAAGTGATTATTCAAAGCTTTGGAGATACTCTTACACAGCAACATAT<br>TACATCTATGACCTTAGCAATGGAGAATTTGTAAGAGGATACGAGCTTCCTCGTCCAATTCAGTA<br>TTTATGCTGGTCGCCTGTTGGGAGTAAATTAGCATATGTCTATCAAAACAATATCTATTTGAAAC<br>AAAGACCAGGAGATCCACCTTTTCAAATAACTTTTACTGGAAGAGAAAATAAAATATTTAATGGA<br>ATCCCAGACTGGGTTTATGAAGAGGAAATGCTTGCTACAAAATATGCTCTCTGGTGGTCTCCTAA<br>TGGAAAATTTTGGCATATGCGGAATTTAATGATTCAGATATACCAGTTATTGCCTATTCCTATT<br>ATGGCGATGAACAATATCCTAGAACAATAAATATTCCATACCCAAAGGCTGGAGCTAAGAATCCC<br>GTTGTTCGGATATTATTGTTGATACCACTTACCCTCACCACGTAGGTCCCATGGAAGTGCCTGT<br>TCCAGAAATGATAGCCTCAAGTGATTATTATTTCAGTTGGCTCACGTGGGTTACTAGTGAACGAG<br>TATGTTTGCAGTGGCTAAAAGAGTCCAGAATGTTTCGGTCCTGTCTATATGTGACTTCAGGGAA |

| SEQ ID NO. | DESIGNATION | SOURCE | TYPE | SEQUENCE |
|---|---|---|---|---|
| | | | | GACTGGCATGCATGGGAATGTCCAAAGAACCAGGAGCATATAGAAGAAAGCAGAACTGGATGGGC<br>TGGTGGATTCTTTGTTTCAACACCAGTTTTCAGCTATGATGCCACTTCGTACTACAAAATATTTA<br>GTGACAAGGATGGCTACAAACATATTCACTATATCAAAGACACTGTGGAAAATGCTATTCAAATT<br>ACAAGTGGCAAGTGGGAGGCCATAAATATATTCAGAGTAACACAGGATTCACTGTTTTATTCTAG<br>CAATGAATTTGAAGAATACCCTGGAAGAAGAAACATCTACAGAATTAGCATTGGAAGCTATCCTC<br>CAAGCAAGAAGTGTGTTACTTGCCATCAAGGAAAGAAAGGTGCCAATATTACACAGCAAGTTTC<br>AGCGACTACGCCAAGTACTATGCACTTGTCTGCTACGGCCCAGGCATCCCCATTTCCACCCTTCA<br>TGATGGACGCACTGATCAAGAAATTAAAATCCTGGAAGAAAACAAGGAATTGGAAAATGCTTTGA<br>AAAATATCCAGCTGCCTAAAGAGGAAATTAAGAAACTTGAAGTAGATGAAATTACTTTATGGTAC<br>AAGATGATTCTTCCTCCTCAATTTGACAGATCAAAGAAGTATCCCTTGCTAATTCAAGTGTATGG<br>TGGTCCCTGCAGTCAGAGTGTAAGGTCTGTATTTGCTGTTAATTGGATATCTTATCTTGCAAGTA<br>AGGAAGGGATGGTCATTGCCTTGGTGGATGGTCGAGGAACAGCTTTCCAAGGTGACAAACTCCTC<br>TATGCAGTGTATCGAAAGCTGGGTGTTTATGAAGTTGAAGACCAGATTACAGCTGTCAGAAAATT<br>CATAGAAATGGGTTTCATTGATGAAAAAAGAATAGCCATATGGGGCTGGTCCTATGGAGGATACG<br>TTTCATCACTGGCCCTTGCATCTGGAACTGGTCTTTTCAAATGTGGTATAGCAGTGGCTCCAGTC<br>TCCAGCTGGGAATATTACGCGTCGTCTACACAGAGAGATTCATGGGTCTCCCAACAAAGGATGA<br>TAATCTTGAGCACTATAAGAACTCAACTGTGATGGCAAGAGCAGAATATTTCAGAAATGTAGACT<br>ATCTTCTCATCCACGGAACAGCAGATGATAATGTGCACTTTCAAAACTCAGCACAGATTGCTAAA<br>GCTCTGGTTAATGCACAAGTGGATTTCCAGGCAATGTGGTACTCTGACCAGAACCACGGCTTATC<br>CGGCCTGTCCACGAACCACTTATACACCCACATGACCCACTTCCTAAAGCAGTGTTTCTCTTTGT<br>CAGACGATTACAAGGACGACGATGACAAGTAA |
| 373. | mutated human FAPα antigen | artificial | aa | MKTWVKIVFGVATSAVLALLVMCIVLRPSRVHNSEENTMRALTLKDILNGTFSYKTFFPNWISGQ<br>EYLHQSADNNIVLYNIETGQSYTILSNRTMKSVNASNYGLSPDRQFVYLESDYSKLWRYSYTATY<br>YIYDLSNGEFVRGYELPRPIQYLCWSPVGSKLAYVYQNNIYLKQRPGDPPFQITYTGRENKIFNG<br>IPDWVYEEEMLATKYALWWSPNGKFLAYAEFNDSDIPVIAYSYYGDEQYPRTINTPYPKAGAKNP<br>VVRIFIVDTTYPHHVGPMEVPVPEMIASSDYYFSWLTWVTSERVCLQWLKRVQNVSVLSICDFRE<br>DWHAWECPKNQEHIEESRTGWAGGFFVSTPVFSYDATSYYKIFSDKDGYKIHYIKDTVENAIQI<br>TSGKWEAINIFRVTQDSLFYSSNEFEEYPGRRNIYRISIGSYPPSKKCVTCHLRKERCQYYTASF<br>SDYAKYYALVCYGPGIPISTLHDGRTDQEIKILEENKELENALKNIQLPKEEIKKLEVDEITLWY<br>KMILPPQFDRSKKYPLLIQVYGGPCSQSVRSVFAVNWISYLASKEGMVIALVDGRGTAFQGDKLL<br>YAVYRKLGVYEVEDQITAVRKFIEMGFIDEKRIAIWGWSYGGYVSSLALASGTGLFKCGIAVAPV<br>SSWEYYASVYTERFMGLPTKDDNLEHYKNSTVMARAEYFRNVDYLLIHGTADDNVHFQNSAQIAK<br>ALVNAQVDFQAMWYSDQNHGLSGLSTNHLYTHMTHFLKQCFSLSDDYKDDDDK |
| 374. | mutated murine FAPα antigen | artificial | nt | ATGAAGACATGGCTGAAAACTGTCTTTGGAGTTACCACCCTGGCTGCGCTTGCTTTAGTGGTGAT<br>ATGCATTGTCTTACGTCCCTCAAGAGTTTACAAACCTGAAGGAAACACAAAGAGAGCTCTTACCT<br>TGAAGGATATTTTAAATGGAACATTCTCATATAAACATATTTTCCCAACTGGATTTCAGAACAA<br>GAATTCTTCATCAATCTGAGGATGATAACATAGTATTTTATAATATTGAAACAAGAGAATCATA<br>TATCATTTTGAGTAATAGCACCATGAAAAGTGTGAATGCTACAGATTATGGTTTGTCACCTGATC<br>GGCAATTTGTGTATCTAGAAAGTGATTATTCAAAGCTCTGGCGATATTCATACACAGCGACATAC<br>TACATCTACGACCTTCAGAATGGGGAATTTGTAAGAGGAAACGAGCTCCCTCGTCCAATTCAGTA<br>TCTATGCTGGTCGCCTGTTGGGAGTAAATTAGCATATGTATATCAAAACAATATTTATTTGAAAC<br>AAAGACCAGGAGATCCACCTTTTCAAATAACTTTTAATGGAAGAGAAAATAGAATATTTAATGGA<br>ATACCAGACTGGGTTTATGAAGAGGAAATGCTTGCCACAAAATATGCTCTTTGGTGGTCTCCAGA<br>TGGTAAATTTTTGGCATATGTAGAATTTAATGATACGGATATACCAATTATTGCCTATTCTTATT<br>ATGGTGATGGACAGTATCCTAGAACTATAAATATTCCATATCCAAAGGCTGGGGCTAAGAATCCG<br>GTTGTTCGTGTTTTTATTATTGACACCACCTACCCTGCCTACGTGGGCCCACAGGAAGTGCCAGT<br>TCCAGCAATGATAGCCTCAAGTGACTATTATTTCAGCTGGCTCACATGGGTGTCCGATGAACGAG<br>TATGCTTGCAGTGGCTAAAAAGAGTGCAGAATGTCTCAGTCCTGTCTATATGTGATTTCAGGGAA<br>GACTGGCACAGACATGGGATTGTCCAAAGACCCAGGAGCATGTAGAAGAAAGCAGAACAGGATGGGC<br>TGGTGGATTCTTTGTTCGACACCAGTTTTAGCCAGGATGCCATTCTTACTACAAAATATTTA<br>GCGACAAGGATGGTTACAAACATATTCACTACATCAAAGACACTGTGGAAAATGCTATTCAAATT<br>ACAAGTGGCAAGTGGGAGGCCATATATATATTCCGCGTAACACAGGATTCACTGTTTTATTCTAG<br>CAATGAATTTGAAGGTTACCCTGGAAGAAGAAACATCTACAGAATTAGCATTGGAAACTCTCCTC<br>CGAGCAAGAAGTGTGTTACTTGCCATCAAGGAAAGAAAGGTGCCAATATTACACAGCAAGTTTC<br>AGCTACAAAGCCAAGTACTATGCACTCGTCTGCTATGGCCCTGGCCTCCCCATTTCCACCCTCCA<br>TGATGGCCGCACAGACCAAGAAATACAAGTATTAGAAGAAACAAAGAACTGGAAAATTCTCTGA<br>GAAATATCCAGCTGCCTAAAGTGGAGATTAAGAAGCTCAAAGACGGGGACTGACTTTCTGGTAC<br>AAGATGATTCTGCCTCCTCAGTTTGACAGATCAAAGAAGTACCCTTTGCTAATTCAAGTGTATGG<br>TGGTCCTTGTAGCCAGAGTGTTAAGTCTGTGTTTGCTGTTAATTGGATAACTTATCTCGCAAGTA<br>AGGAGGGGATAGTCATTGCCCTGGTAGATGGTCGGGGCACTGCTTTCCAAGGTGACAAATTCCTG<br>CATGCCGTGTATCGAAAACTGGGTGTATATGAAGTTGAGGACCAGCTCACAGCTGTCAGAAAATT<br>CATAGAAATGGGTTTCATTGATGAAGAAAAGAATAGCCATATGGGGCTGGTCCTACGGAGGTTATG<br>TTTCATCCCTGGCCCTTGCATCTGGAACTGGTCTTTTCAAATGTGGCATAGCAGTGGCTCCAGTC<br>TCCAGCTGGGAATATTACGCATCTATCTACTCAGAGAGATTCATGGGCCTCCCAACAAAGGACGA<br>CAATCTCGAACACTATAAAAATTCAACTGTGATGGCAAGAGCAGAATATTTCAGAAATGTAGACT<br>ATCTTCTCATCCACGGAACAGCAGATGATAATGTGCACTTTCAGAACTCAGCACAGATTGCTAAA<br>GCTTTGGTTAATGCACAAGTGGATTTCCAGGCGATGTGGTACTCTGACCAGAACCATGGATATC<br>ATCTGGGCCTCCCAGAATCATTTATATACCCACATGACGCACTTCCTCAAGCAATGCTTTTCTT<br>TATCAGACGATTACAAGGACGACGATGACAAGTAG |
| 375. | mutated murine FAPα antigen | artificial | aa | MKTWLKTVFGVTTLAALALVVICIVLRPSRVYKPEGNTKRALTLKDILNGTFSYKTYFPNWISEQ<br>EYLHQSEDDNIVFYNIETRESYIILSNSTMKSVNATDYGLSPDRQFVYLESDYSKLWRYSYTATY<br>YIYDLQNGEFVRGNELPRPIQYLCWSPVGSKLAYVYQNNIYLKQRPGDPPFQITFNGRENRIFNG |

| SEQ ID NO. | DESIGNATION | SOURCE | TYPE | SEQUENCE |
|---|---|---|---|---|
| | | | | IPDWVYEEEMLATKYALWWSPDGKFLAYVEFNDTDIPIIAYSYYGDGQYPRTINIPYPKAGAKNP VVRVFIIDTTYPAYVGPQEVPVPAMIASSDYYFSWLTWVSDERVCLQWLKRVQNVSVLSICDFRE DWQTWDCPKTQEHVEESRTGWAGGFFVSTPAFSQDAISYYKIFSDKDGYKIHYIKDTVENAIQI TSGKWEAIYIFRVTQDSLFYSSNEFEGYPGRRNIYRISIGNSPPSKKCVTCHLRKERCQYYTASF SYKAKYYALVCYGPGLPISTLHDGRTDQEIQVLEENKELENSLRNIQLPKVEIKKLKDGGLTFWY KMILPPQFDRSKKYPLLIQVYGGPCSQSVKSVFAVNWITYLASKEGIVIALVDGRGTAFQGDKFL HAVYRKLGVYEVEDQLTAVRKFIEMGFIDEERIAIWGWSYGGYVSSLALASGTGLFKCGIAVAPV SSWEYYASIYSERFMGLPTKDDNLEHYKNSTVMARAEYFRNVDYLLIHGTADDNVHFQNSAQIAK ALVNAQVDFQAMWYSDQNHGISSGRSQNHLYTHMTHFLKQCFSLSDDYKDDDDK |
| 376. | macaque FAPα forward primer | artificial | nt | CAGCTTCCAACTACAAAGACAGAC |
| 377. | macaque FAPα reverse primer | artificial | nt | TTTCCTCTTCATAAACCCAGTCTGG |
| 378. | macaque FAPα forward primer | artificial | nt | TTGAAACAAAGACCAGGAGATCCACC |
| 379. | macaque FAPα reverse primer | artificial | nt | AGATGGCAAGTAACACACTTCTTGC |
| 380. | macaque FAPα forward primer | artificial | nt | GAAGAAACATCTACAGAATTAGCATTGG |
| 381. | macaque FAPα reverse primer | artificial | nt | CACATTTGAAAAGACCAGTTCCAGATGC |
| 382. | macaque FAPα forward primer | artificial | nt | AGATTACAGCTGTCAGAAAATTCATAGAAATGG |
| 383. | macaque FAPα reverse primer | artificial | nt | ATATAAGGTTTTCAGATTCTGATACAGGC |
| 384. | macaque FAPα | artificial | nt | ATGAAGACTTGGGTAAAAATCGTATTTGGAGTTGCCACCTCTGCTGTGCTTGCCTTATTGGTGAT GTGCATTGTCTTACGCCCTCCAAGAGTTCATAACTCTGAAGAAAATACAATGAGAGCACTCACAC TGAAGGATATTTTAAATGGGACATTTTCTTATAAAACATTTTTTCCAAACTGGATTTCAGGACAA GAATATCTTCATCAATCTGCAGATAACAATATAGTACTTTATAATATTGAAACAGGACAATCATA TACCATTTTGAGTAACAGAACCATGAAAAGTGTGAATGCTTCAAATTATGGCTTATCACCTGATC GGCAATTTGTATATCTAGAAAGTGATTATTCAAAGCTTTGGAGATACTCTTACACAGCAACATAT TACATCTATGACCTTAGCAATGGAGAATTTGTAAGAGGAAATGAGCTTCCTCGTCCAATTCAGTA TTTATGCTGGTCGCCTGTTGGGAGTAAATTAGCATATGTCTATCAAAACAATATCTATTTGAAAC AAAGACCAGGAGATCCACCTTTTCAAATAACATTTAATGGAAGAGAAAATAAAATATTTAATGGA ATCCCAGACTGGGTTTATGAAGAGGAAATGCTTGCTACAAAATATGCTCTCTGGTGGTCTCCTAA TGGAAAATTTTTGGCATATGCGGAATTTAATGATACAGATATACCAGTTATTGCCTATTCCTATT ATGGCGATGAACAATATCCCAGAACAATAAATATTCCATACCCAAAGGCGGAGCTAAGAATCCT TTTGTTCGGATATTTATTATCGATACCACTTACCCTGCGTATGTAGGTCCCCAGGAAGTGCCTGT TCCAGCAATGATAGCCTCAAGTGATTATTATTTCAGTTGGCTCACGTGGGTTACTGATGAACGAG TATGTTTGCAGTGGCTAAAAAGAGTCCAGAATGTTTCGGTCTTGTCTATATGTGATTTCAGGGAA GACTGGCAGACATGGGATTGTCCAAAGACCCAGGAGCATATAGAAGAAAGCAGAACTGGATGGGC TGGTGGATTCTTTGTTTCAACACCAGTTTTCAGCTATGATGCCATTTCATACTACAAAATATTTA GTGACAAGGATGGCTACAAACATATTCACTATATCAAAGACACTGTGGAAAATGCTATTCAAATT ACAAGTGGCAAGTGGGAGGCCATAAATATATTCAGAGTAACACAGGATTCACTGTTTTATTCTAG CAATGAATTTGAAGATTACCCTGGAAGAAGAAACATCTACAGAATTAGCATTGGAAGCTATCCTC CAAGCAAGAAGTGTGTTACTTGCCATCTAAGGAAAGAAAGGTGCCAATATTACACAGCAAGTTTC AGCGACTACGCCAAGTACTATGCACTTGTCTGCTATGGCCCAGGCATCCCCATTTCCACCCTTCA TGACGGACGCACTGATCAAGAATTAAAATCCTGGAAGAAAACAAGGAATTGGAAAATGCTTTGA AAAATATCCAGCTGCCTAAAGAGGAAATTAAGAAACTTGAAGTAGATGAAATTACTTTATGGTAC AAGATGATTCTTCCTCCTCAATTTGACAGATCAAAGAAGTATCCCTTGCTAATTCAAGTGTATGG TGGTCCCTGCAGTCAGAGTGTRAGGTCTGTATTTGCTGTTAATTGGATATCKTATCTTGCAAGTA AGGAAGGGATGGTCATTGCCTTGGTGGATGGTCGAGGAACAGCTTTCCAAGGTGACAAACTCCTG TATGCAGTGTATCGAAAGCTGGGTGTTTATGAAGTTGAAGACCAGATTACAGCTGTCAGAAAATT CATAGAAATGGGTTTCATTGATGAAAAAGAATAGCCATATGGGCTGGTCCTATGGAGGATAYG TTTCATCACTGGCCCTTGCATCTGGAACTGGTCTTTTCAAATGTGGGATAGCAGTGGCTCCAGTC TCCAGCTGGGAATATTACGCGTCTGTCTACACAGAAAGATTCATGGGTCTTCCCACAAAGGATGA TAATCTTGAGCACTACAAAAATTCAACTGTGATGGCAAGAGCAGAATATTTCAGAAATGTAGACT ATCTTCTCATCCACGGAACAGCAGATGATAATGTGCACTTTCAAAACTCAGCACAGATTGCTAAA GCTCTGGTTAATGCACAAGTGGATTTCCAGGCAATGTGGTACTCTGACCAGAACCACGGCTTATC CGGCCTGTCCACGAACCACTTATACACCCACATGACCCACTTTCTAAAGCAGTGTTTTTCTTTGT CGGACTAA |
| 385. | macaque FAPα | artificial | aa | MKTWVKIVFGVATSAVLALLVMCIVLRPPRVHNSEENTMRALTLKDILNGTFSYKTFFPNWISGQ EYLHQSADNNIVLYNIETGQSYTILSNRTMKSVNASNYGLSPDRQFVYLESDYSKLWRYSYTATY YIYDLSNGEFVRGNELPRPIQYLCWSPVGSKLAYVYQNNIYLKQRPGDPPFQITFNGRENKIFNG IPDWVYEEEMLATKYALWWSPNGKFLAYAEFNDTDIPVIAYSYYGDEQYPRTINIPYPKAGAKNP |

| SEQ ID NO. | DESIGNATION | SOURCE | TYPE | SEQUENCE |
|---|---|---|---|---|
| | | | | FVRIFIIDTTYPAYVGPQEVPVPAMIASSDYYFSWLTWVTDERVCLQWLKRVQNVSVLSICDFRE DWQTWDCPKTQEHIEESRTGWAGGFFVSTPVFSYDAISYYKIFSDKDGYKHIHYIKDTVENAIQI TSGKWEAINIFRVTQDSLFYSSNEFEDYPGRRNIYRISIGSYPPSKKCVTCHLRKERCQYYTASF SDYAKYYALVCYGPGIPISTLHDGRTDQEIKILEENKELENALKNIQLPKEEIKKLEVDEITLWY KMILPPQFDRSKKYPLLIQVYGGPCSQSVRSVFAVNWISYLASKEGMVIALVDGRGTAFQGDKLL YAVYRKLGVYEVEDQITAVRKFIEMGFIDEKRIAIWGWSYGGYVSSLALASGTGLFKCGIAVAPV SSWEYYASVYTERFMGLPTKDDNLEHYKNSTVMARAEYFRNVDYLLIHGTADDNVHFQNSAQIAK ALVNAQVDFQAMWYSDQNHGLSGLSTNHLYTHMTHFLKQCFSLSD |
| 386. | human C-MET construct | artificial | nt | ATGAAGGCCCCCGCTGTGCTTGCACCTGGCATCCTCGTGCTCCTGTTTACCTTGGTGCAGAGGAG CAATGGGGAGTGTAAAGAGGCACTAGCAAAGTCGGAGATGAATGTGAATATGAAGTATCAGCTTC CCAACTTCACCGCGGAAACACCCATCCAGAATGTCATTCTACATGAGCATCACATTTTCCTTGGT GCCACTAACTACATTTATGTTTTAAATGAGGAAGACCTTCAGAAGGTTGCTGAGTACAAGACTGG GCCTGTGCTGGAACACCCAGATTGTTTCCCATGTCAGGACTGCAGCAGCAAAGCCAATTTATCAG GAGGTGTTTGGAAAGATAACATCAACATGGCTCTAGTTGTGGACACCTACTATGATGATCAACTC ATTAGCTGTGGCAGCGTCAACAGAGGGACCTGCCAGCGACATGTCTTTCCCCACAATCATACTGC TGACATACAGTCGGAGGTTCACTGCATATTCTCCCCACAGATAGAAGAGCCCAGCCAGTGTCCTG ACTGTGTGGTGAGCGCCCTGGGAGCCAAAGTCCTTTCATCTGTAAAGGACCAGGTTCATCAACTTC TTTGTAGGCAATACCATAAATTCTTCTTATTTCCCAGATCATCCATTGCATCGATATCAGTGAG AAGGCTAAAGGAAACGAAAGATGGTTTTATGTTTTTGACGGACCAGTCCTACATTGATGTTTTAC CTGAGTTCAGAGATTCTTACCCCATTAAGTATGTCCATGCCTTTGAAAGCAACAATTTTATTTAC TTCTTGACGGTCCAAAGGGAAACTCTAGATGCTCAGACTTTTCACACAAGAATAATCAGGTTCTG TTCCATAAACTCTGGATTGCATTCCTACATGGAAATGCCTCTGGAGTGTATTCTCACAGAAAAGA GAAAAAAGAGATCCACAAAGAAGGAAGTGTTTAATATACTTCAGGCTGCGTATGTCAGCAAGCCT GGGGCCCAGCTTGCTAGACAAATAGGAGCCAGCCTGAATGATGACATTCTTTTCGGGGTGTTCGC ACAAAGCAAGCCAGATTCTGCCGAACCAATGGATCGATCTGCCCATGTGTGCATTCCCTATCAAAT ATGTCAACGACTTCTTCAACAAGATCGTCAACAAAAACAATGTGAGATGTCTCCAGCATTTTTAC GGACCCAATCATGAGCACTGCTTTAATAGGACACTTCTGAGAAATTCATCAGGCTGTGAAGCGCG CCGTGATGAATATCGAACAGAGTTTACCACAGCTTTGCAGCGCGTTGACTTATTCATGGGTCAAT TCAGCGAAGTCCTCTTAACATCTATATCCACCTTCATTAAAGGAGACCTCCACCATAGCTAATCTT GGGACATCAGAGGGTCGCTTCATGCAGGTTGTGGTTTCTCGATCAGGACCATCAACCCCTCATGT GAATTTTCTCCTGGACTCCCATCCAGTGTCTCCAGAAGTGATTGTGGAGCATACATTAAACCAAA ATGGCTACACACTGGTTATCACTGGGAAGAAGATCACGAAGATCCCATTGAATGGCTTGGGCTGC AGACATTTCCAGTCCTGCAGTCAATGCCTCTTCTGCCCCACCCTTTGTTCAGTGTGGCTGGTGCCA CGACAAATGTGTGCGATCGGAGGAATGCCTGAGCGGGACATGGACTCAACAGATCTGTCTGCCTG CAATCTACAAGGTTTTCCCAAATAGTGCACCCCTTGAAGGAGGGACAAGGCTGACCATATGTGGC TGGGACTTTGGATTTCGGAGGAATAATAAATTTGATTTAAAGAAAACTAGAGTTCTCCTTGGAAA TGAGAGCTGCACCTTGACTTTAAGTGAGAGCACGATGAATACATTGAAATGCACAGTTGGTCCTG CCATGAATAAGCATTTCAATATGTCCATAATTATTTCAAATGGCCACGGGACAACACAATACAGT ACATTCTCCTATGTGGATCCTGTAATAACAAGTATTTCGCCGAAATACGGTCCTATGGCTGGTGG CACTTTACTTACTTTAACTGGAAATTACCTAAACAGTGGGAATAGCAGACACATTTCAATTGGTG GAAAAACATGTACTTTAAAAAGTGTGTCAAACAGTATTCTTGAATGTTATACCCCAGCCCAAACC ATTTCAACTGAGTTTGCTGTTAAATTGAAAATTGACTTAGCCAACCGAGAGACAAGCATCTTCAG TTACCGTGAAGATCCCATTGTCTATGAAATTCATCCAACCAAATCTTTTATTAGTGGTGGGAGCA CAATAACAGGTGTTGGGAAAAACCTGAACTCAGTTAGTGTCCCGAGAATGGTCATAAATGTGCAT GAAGCAGGAAGGAACTTTACAGTGGCATGTCAACATCGCTCTAATTCAGAGATAATCTGTTGTAC CACTCCTTCCCTGCAACAGCTGAATCTGCAACTCCCCCTGAAAACCAAAGCCTTTTCATCTTAG ATGGGATCCTTTCCAAATACTTTGATCTCATTTATGTACATAATCCTGTGTTTAAGCCTTTTGAA AAGCCAGTGATGATCTCAATGGGCAATGAAATGTACTGGAAATTAAGGGAAATGATATTGACCC TGAAGCAGTTAAAGGTGAAGTGTTAAAAGTTGGAAATAAGAGCTGTGAGAATATACACTTACATT CTGAAGCCGTTTTATGCACGGTCCCCAATGACCTGCTGAAATTGAACAGCGAGCTAAATATAGAG TGGAAGCAAGCAATTTCTTCAACCGTCCTTGGAAAAGTAATAGTTCAACCAGATCAGAATTTCAC AGGATTGATTGCTGGTGTTGTCTCAATATCAACAGCACTGTTATTACTTGGGTTTTTCCTGTG GGCTGAAAAGAGAAAGCAAATTAAAGATCTGGGCAGTGAATTAGTTCGCTACGATGCAAGAGTA CACACTCCTCATTTGGATAGGCTTGTAAGTGCCCGAAGTGTAAGCCCAACTACAGAAATGGTTTC AAATGAATCTGTAGACTACCGAGCTACTTTTCCAGAAGATCAGTTTCCTAATTCATCTCAGAACG GTTCATGCCGACAAGTGCAGTATCCTCTGACAGACATGTCCCCCATCCTAACTAGTGGGGACTCT GATATATCCAGTCCATTACTGCAAAATACTGTCCACATTGACCTCAGTGCTCTAAATCCAGAGCT GGTCCAGGCAGTGCAGCATGTAGTGATTGGGCCCAGTAGCCTGATTGTGCATTTCAATGAAGTCA TAGGAAGAGGGCATTTTGGTTGTGTATATCATGGGACTTTGTTGGACAATGATGGCAAGAAAATT CACTGTGCTGTGAAATCCTTGAACAGAATCACTGACATAGGAGAAGTTTCCCAATTTCTGACCGA GGGAATCATCATGAAAGATTTAGTCATCCCAATGTCCTCTCGCTCCTGGGAATCTGCCTGCGAA GTGAAGGGTCTCCGCTGGTGGTCCTACCATACATGAAACATGGAGATCTTGAAATTTCATTCGA AATGAGACTCATAATCAACTGTAAAAGATCTTATTGGCTTTGGTCTTCAAGTAGCCAAAGGCAT GAAATATCTTGCAAGCAAAAAGTTTGTCCACAGAGATTGGCTGCAAGAAACTGTATGCTGGATG AAAAATTCACAGTCAAGGTTGCTGATTTTGGTCTTGCCAGAGACATGTATGATAAAGAATACTAT AGTGTACACAACAAAACAGGTGCAAAGCTGCCAGTGAAGTGGATGGCTTTGGAAAGTCTGCAAAC TCAAAAGTTTACCACCAAGTCAGATGTGGTCCTTTGGCGTGCTCCTCTGGGAGCTGATGACAA GAGGAGCCCCACCTTATCCTGACGTAAACACCTTTGATATAACTGTTTTTACTTGTCAAGGGAGA AGACTCCTACAACCCGAATACTGCCCAGACCCCTTATATGAAGTAATGCTAAAATGCTGGCACCC TAAAGCCGAAATGCGCCCATCCTTTTCTGAACTGGTGTCCGGATATCAGCGATCTTCTCTACTT TCATTGGGGAGCACTATGTCCATGTGAACGCTACTTATGTGAACGTAAATGTGTCGCTCCGTAT CCTTCTCTGTTGTCATCAGAAGATAACGCTGATGATGAGGTGGACACGACCAGCCTCCTTCTG GGAGACATCATAG |

| SEQ ID NO. | DESIGNATION | SOURCE | TYPE | SEQUENCE |
|---|---|---|---|---|
| 387. | human C-MET construct | artificial | aa | MKAPAVLAPGILVLLFTLVQRSNGECKEALAKSEMNVNMKYQLPNFTAETPIQNVILHEHHIFLG ATNYIYVLNEEDLQKVAEYKTGPVLEHPDCFPCQDCSSKANLSGGVWKDNINMALVVDTYYDDQL ISCGSVNRGTCQRHVFPHNHTADIQSEVHCIFSPQIEEPSQCPDCVVSALGAKVLSSVKDRFINF FVGNTINSSYFPDHPLHSISVRRLKETKDGFMFLTDQSYIDVLPEFRDSYPIKYVHAFESNNFIY FLTVQRETLDAQTFHTRIIRFCSINSGLHSYMEMPLECILTEKRKKRSTKKEVFNILQAAYVSKP GAQLARQIGASLNDDILFGVFAQSKPDSAEPMDRSAMCAFPIKYVNDFFNKIVNKNNVRCLQHFY GPNHEHCFNRTLLRNSSGCEARRDEYRTEFTTALQRVDLFMGQFSEVLLTSISTFIKGDLTIANL GTSEGRFMQVVVSRSGPSTPHVNFLLDSHPVSPEVIVEHTLNQNGYTLVITGKKITKIPLNGLGC RHFQSCSQCLSAPPPFVQCGWCHDKCVRSEECLSGTWTQQICLPAIYKVFPNSAPLEGGTRLTICG WDFGFRRNNKFDLKKTRVLLGNESCTLTLSESTMNTLKCTVGPAMNKHFNMSIIISNGHGTTQYS TFSYVDPVITSISPKYGPMAGGTLLLTLTGNYLNSGNSRHISIGGKTCTLKSVSNSILECYTPAQT ISTEFAVKLKIDLANRETSIFSYREDPIVYEIHPTKSFISGGSTITGVGKNLNSVSVPRMVINVH EAGRNFTVACQHRSNSEIICCTTPSLQQLNLQLPLKTKAFFMLDGILSKYFDLIYVHNPVFKPFE KPVMISMGNENVLEIKGNDIDPEAVKGEVLKVGNKSCENIHLHSEAVLCTVPNDLLKLNSELNIE WKQAISSTVLGKVIVQPDQNFTGLIAGVVSISTALLLLLGFFLWLKKRKQIKDLGSELVRYDARV HTPHLDRLVSARSVSPTTEMVSNESVDYRATFPEDQFPNSSQNGSCRQVQYPLTDMSPILTSGDS DISSPLLQNTVHIDLSALNPELVQAVQHVVIGPSSLIVHFNEVIGRGHFGCVYHGTLLDNDGKKI HCAVKSLNRITDIGEVSQFLTEGIIMKDFSHPNVLSLLGICLRSEGSPLVVLPYMKHGDLRNFIR NETHNPTVKDLIGFGLQVAKGMKYLASKKFVHRDLAARNCMLDEKFTVKVADFGLARDMYDKEYY SVHNKTGAKLPVKWMALESLQTQKFTTKSDVWSFGVLLWELMTRGAPPYPDVNTFDITVYLLQGR RLLQPEYCPDPLYEVMLKCWHPKAEMRPSFSELVSRISAIFSTFIGEHYVHVNATYVNVKCVAPY PSLLSSEDNADDEVDTRPASFWETS |
| 388. | soluble fusion protein of h C-MET and m IgG1 Fc | artificial | nt | ATGAAGGCCCCCGCTGTGCTTGCACCTGGCATCCTCGTGCTCCTGTTTACCTTGGTGCAGAGGAG CAATGGGGAGTGTAAAGAGGCACTAGCAAAGTCCGAGATGAATGTGAATATGAAGTATCAGCTTC CCAACTTCACCGCGGAAACACCCATCCAGAATGTCATTCTACATGAGCATCACATTTTCCTTGGT GCCACTAACTACATTTATGTTTTAAATGAGGAAGACCTTCAGAAGGTTGCTGAGTACAAGACTGG GCCTGTGCTGGAACACCCAGATTGTTTCCCATGTCAGGACTGCAGCAGCAAAGCCAATTTATCAG GAGGTGTTTGGAAAGATAACATCAACATGGCTCTAGTTGTGGACACCTACTATGATGATCAACTC ATTAGCTGTGGCAGCGTCAACAGAGGGACCTGCCAGCGACATGTCTTTCCCCACAATCATACTGC TGACATACAGTCGGAGGTTCACTGCATATTCTCCCCACAGATAGAAGAGCCCAGCCAGTGTCCTG ACTGTGTGGTCAGCGCCCTGGGAGCCAAAGTCCTTTCATCTGTAAAGGACCGGTTCATCAACTTC TTTGTAGGCAATACCATAAATTCTTCTTATTTCCCAGATCATCCATTGCATTCGATATCAGTGAG AAGGCTAAAGGAAACGAAAGATGGTTTTGACGGACCAGTCCTACATTGATGTTTTAC CTGAGTTCAGAGATTCTTACCCCATTAAGTATGTCCATGCCTTTGAAAGCAACAATTTTATTTAC TTCTTGACGGTCCAAAGGGAAACTCTAGATGCTCAGACTTTTCACACAAGAATAATCAGGTTCTG TTCCATAAACTCTGGATTGCATTCCTACATGGAAATGCCTCTGGAGTGTATTCTCACAGAAAAGA GAAAAAAGAGATCCACAAAGAAGGAAGTGTTTAATATACTTCAGGCTGCGTATGTCAGCAAGCCT GGGGCCCAGCTTGCTAGACAAATAGGAGCCAGCCTGAATGATGACATTCTTTTCGGGGTGTTCGC ACAAAGCAAGCCAGATTCTGCCGAACCAATGGATCGATCTGCCATGTGTGCATTCCCTATCAAAT ATGTCAACGACTTCTTCAACAAGATCGTCAACAAAAACAATGTGAGATGTCTCCAGCATTTTTAC GGACCCAATCATGAGCACTGCTTTAATAGGACACTTCTGAGAAATTCATCAGGCTGTGAAGCGCG CCGTGATGAATATCGAACAGAGTTTACCACAGCTTTGCAGCGCGTTGACTTATTCATGGGTCAAT TCAGCGAAGTCCTCTTAACATCTATATCCACCTTCATTAAAGGAGACCTCACCATAGCTAATCTT GGGACATCAGAGGGTCGCTTCATGCAGGTTGTGGTTTCTCGATCAGGACCATCAACCCCTCATGT GAATTTTCTCCTGGACTCCCATCCAGTGTCTCCAGAAGTGATTGTGGAGCATACATTAAACCAAA ATGGCTACACACTGGTTATCACTGGGAAGAAGATCACGAAGATCCCATTGAATGGCTTGGGCTGC AGACATTTCCAGTCCTGCAGTCAATGCCTCTCTGCCCCACCCTTTGTTCAGTGTGGCTGGTGCCA CGACAAATGTGTGCGATCGGAGGAATGCCTGAGCGGGACATGGACTCAACAGATCTGTCTGCCTG CAATCTACAAGGTTTTCCCAAATAGTGCACCCCTTGAAGGAGGGACAAGGCTGACCATATGTGGC TGGGACTTTGGATTTCGGAGGAATAATAAATTTGATTTAAAGAAAACTAGAGTTCTCCTTGGAAA TGAGAGCTGCACCTTGACTTTAAGTGAGAGCACGATGAATACATTGAAATGCACAGTTGGTCCTG CCATGAATAAGCATTTCAATATGTCCATAATTATTTCAAATGGCCACGGGACAACACAATACAGT ACATTCTCCTATGTGGATCCTGTAATAACAAGTATTTCGCCGAAATACGGTCCTATGGCTGGTGG CACTTTACTTACTTTAACTGGAAATTACCTAAACAGTGGGAATAGCAGACACATTTCAATTGGTG GAAAAACATGTACTTTAAAAAGTGTGTCAAACAGTATTCTTGAATGTTATACCCCAGCCCAAACC ATTTCAACTGAGTTTGCTGTTAAATTGAAAATTGACTTAGCCAACCGAGAGACAAGCATCTTCAG TTACCGTGAAGATCCCATTGTCTATGAAATTCATCCAACCAAATCTTTTATTAGTGGTGGGAGCA CAATAACAGGTGTTGGGAAAAACCTGAACTCAGTTAGTGTCCCGAGAATGGTCATAAATGTGCAT GAAGCAGGAAGGAACTTTACAGTGGCATGTCAACATCGCTCTAATTCAGAGATAATCTGTTGTAC CACTCCTTCCCTGCAACAGCTGAATCTGCAACTCCCCCTGAAACCAAAGCCTTTTTCATGTTAG ATGGGATCCTTTCCAAATACTTTGATCTCATTTATGTACATAATCCTGTGTTTAAGCCTTTTGAA AAGCCAGTGATGATCTCAATGGGCAATGAAAATGTACTGGAAATTAAGGGAAATGATATTGACCC TGAAGCAGTTAAAGGTGAAGTGTTAAAAGTTGGAAATAAGAGCTGTGAGAATATACACTTACATT CTGAAGCCGTTTTATGCACGGTCCCCAATGACCTGCTGAAATTGAACAGCGAGCTAAATATAGAG TGGAAGCAAGCAATTTCTTCAACCGTCCTTGGAAAAGTAATAGTTCAACCAGATCAGAATTTCAC ATCCGGAGGTGGTGGATCCGTGCCCAGGGATTGTGGTTGTAAGCCTTGCATATGTACAGTCCCAG AAGTATCATCTGTCTTCATCTTCCCCCCAAAGCCCAAGGATGTGCTCACCATTACTCTGACTCCT AAGGTCACGTGTGTTGTGGTAGACATCAGCAAGGATGATCCCGAGGTCCAGTTCAGCTGGTTTGT AGATGATGTGGAGGTGCACACAGCTCAGACGAAACCCCGGGAGGAGCAGATCAACAGCACTTTCC GTTCAGTCAGTGAACTTCCCATCATGCACCAGGACTGGCTCAATGGCAAGGAGTTCAAATGCAGG GTCAACAGTGCAGCTTTCCCTGCCCCCATCGAGAAAACCATCTCCAAAACCAAAGGCAGACCGAA GGCTCCACAGGTGTACACCATTCCACCTCCCAAGGAGCAGATGGCCAAGGATAAAGTCAGTCTGA CCTGCATGATAACAAACTTCTTCCCTGAAGACATTACTGTGGAGTGGCAGTGGAATGGGCAGCCA GCGGAGAACTACAAGAACACTCAGCCCATCATGGACACAGATGGCTCTTACTTCGTCTACAGCAA |

| SEQ ID NO. | DESIGNATION | SOURCE | TYPE | SEQUENCE |
|---|---|---|---|---|
| | | | | GCTCAATGTGCAGAAGAGCAACTGGGAGGCAGGAAATACTTTCACCTGCTCTGTGTTACATGAGG GCCTGCACAACCACCATACTGAGAAGAGCCTCTCCCACTCTCCTGGTAAATCCGGGCATCATCAC CATCATCATTGA |
| 389. | soluble fusion protein of h C-MET and m IgG1 Fc | artificial | aa | MKAPAVLAPGILVLLFTLVQRSNGECKEALAKSEMNVNMKYQLPNFTAETPIQNVILHEHHIFLG ATNYIYVLNEEDLQKVAEYKTGPVLEHPDCFPCQDCSSKANLSGGVWKDNINMALVVDTYYDDQL ISCGSVNRGTCQRHVFPHNHTADIQSEVHCIFSPQIEEPSQCPDCVVSALGAKVLSSVKDRFINF FVGNTINSSYFPDHPLHSISVRRLKETKDGFMFLTDQSYIDVLPEFRDSYPIKYVHAFESNNFIY FLTVQRETLDAQTFHTRIIRFCSINSGLHSYMEMPLECILTEKRKKRSTKKEVFNILQAAYVSKP GAQLARQIGASLNDDILFGVFAQSKPDSAEPMDRSAMCAFPIKYVNDFFNKIVNKNNVRCLQHFY GPNHEHCFNRTLLRNSSGCEARRDEYRTEFTTALQRVDLFMGQFSEVLLTSISTFIKGDLTIANL GTSEGRFMQVVVSRSGPSTPHVNELLDSHPVSPEVIVEHTLNQNGYTLVITGKKITKIPLNGLGC RHFQSCSQCLSAPPFVQCGWCHDKCVRSEECLSGTWTQQICLPAIYKVFPNSAPLEGGTRLTICG WDFGFRRNNKFDLKKTRVLLGNESCTLTLSESTMNTLKCTVGPAMNKHFNMSIIISNGHGTTQYS TFSYVDPVITSISPKYGPMAGGTLLTLTGNYLNSGNSRHISIGGKTCTLKSVSNSILECYTPAQT ISTEFAVKLKIDLANRETSIFSYREDPIVYEIHPTKSFISGGSTITGVGKNLNSVSVPRMVINVH EAGRNFTVACQHRSNSEIICCTTPSLQQLNLQLPLKTKAFFMLDGILSKYFDLIYVHNPVFKPFE KPVMISMGNENVLEIKGNDIDPEAVKGEVLKVGNKSCENIHLHSEAVLCTVPNDLLKLNSELNIE WKQAISSTVLGKVIVQPDQNFTSGGGGSVPRDCGCKPCICTVPEVSSVFIFPPKPKDVLTITLTP KVTCVVVDISKDDPEVQFSWFVDDVEVHTAQTKPREEQINSTFRSVSELPIMHQDWLNGKEFKCR VNSAAFPAPIEKTISKTKGRPKAPQVYTIPPPKEQMAKDKVSLTCMITNFFPEDITVEWQWNGQP AENYKNTQPIMDTDGSYFVYSKLNVQKSNWEAGNTFTCSVLHEGLHNHHTEKSLSHSPGKSGHHH HHH |
| 390. | murine C-MET construct | artificial | nt | ATGGGATGGAGCTGTATCATCCTCTTCTTGGTAGCAACAGCTACAGGTGTACACTCCGATTACAA GGACGACGATGACAAGGAGTGCAAGGAGGCCCTAGTGAAGTCTGAGATGAACGTGAACATGAAGT ATCAGCTCCCCAACTTCACGGCAGAAACCCCCATCCAGAATGTCGTCCTACACGGCCATCATATT TATCTCGGAGCCACAAACTACATTTATGTTTTAAATGACAAAGACCTTCAGAAGGTATCCGAGTT CAAGACCGGGCCCGTGTTGGAACACCCAGATTGTTTACCTTGTCGGGACTGCAGCAGCAAAGCCA ATTCATCAGGAGGGGTTTGGAAAGACAACATCAACATGGCTCTGCTTGTTGACACATACTATGAT GATCAACTCATTAGCTGTGGCAGTGTCAACAGAGGGACTTGCCAGCGGCATGTCCTTCCTCCTGA CAATTCTGCTGACATCCAGTCTGAGGTCCACTGCATGTTCTCCCCAGAAGAGGAGTCAGGGCAGT GTCCTGACTGTGTAGTGAGTGCCCTCGGAGCCAAAGTCCTCCTGTCGGAAAAGGACCGGTTCATC AATTTCTTTGTGGGGAATACGATCAATTCCTCCTATCCTCCTGGTTATTCACTGCATTCGATATC GGTGAGACGGCTGAAGGAAACCCAAGATGGTTTTAAGTTTTTGACAGACCAGTCCTATATTGATG TCTTACCAGAGTTCCAAGATTCCTACCCCATAAAGTACATACATGCCTTCGAAAGCAACCATTTT ATTTACTTTCTGACTGTCCAAAAGGAAACTCTAGATGCTCAGACTTTTCATACAAGAATAATCAG GTTCTGTTCCGTAGACTCTGGGTTGCACTCCTACATGGAAATGCCCCTGGAATGCATCCTGACAG AAAAAAGAAGGAAGAGATCCACAAGGGAAGAAGTGTTTAATATCCTCCAAGCCGCTATGTCAGT AAACCAGGGGCCAATCTTGCTAAGCAAATAGGAGCTAGCCCTTCTGATGACATTCTCTTCGGGGT GTTTGCACAAAGCAAGCCAGATTCTGCTGAACCTGTGAATGATCAGCAGTCTGTGCATTCCCCA TCAAATATGTCAATGACTTCTTCAACAAGATTGTCAACAAAAACAACGTGAGATGTCTCCAGCAT TTTTACGGACCCAACCATGAGCACTGTTTCAATAGGACCCTGCTGAGAAACTCTTCCGGCTGTGA AGCGCGCAGTGACGAGTATCGGACAGAGTTTACCACGGCTTTGCAGCGCGTCGATTTATTCATGG GCCGGCTTAACCAAGTGCTCCTGACATCCATCTCCACCTTCATCAAAGGTGACCTCACCATTGCT AATCTAGGGACGTCAGAAGGTCGCTTCATGCAGGTGGTGCTCTCTGAACAGCACACCTCACTCC TCATGTGAACTTCCTCCTGGACTCCATCCTGTATCTCCAGAAGTTATTGTTGAGCATCCATCAA ATCAAAATGGCTATACATTGGTTGTCACAGGAAAGAAGATCACCAAGATTCCATTGAATGGCCTG GGCTGTGGACATTTCCAATCCTGCAGTCAGTGCCTCTCTGCCCCTTACTTTATACAGTGTGGCTG GTGCCACAATAATGTGTGCGTTTTGATGAATGCCCCAGCGGTACATGGACTCAAGAGATCTGTC TGCCGGCGGTTTATAAGGTGTTCCCCACCAGCGCGCCCCTTGAAGGAGGAACAGTGTTGACCATA TGTGGCTGGGACTTTGGATTCAGGAAGAATAATAAATTTGATTTAAGGAAAACCAAAGTTCTGCT TGGCAACGAGAGCTGTACCTTGACCTTAAGCGAGAGCACGACAAATACGTTGAAATGCACAGTTG GTCCCGCGATGAGTGAGCACTTCAATGTGTCTGTAATTATCTCAAACAGTCGAGAGACGACGCAA TACAGTGCATTCTCCTATGTAGATCCTGTAATAACAAGCATTTCTCCGAGGTACGGCCCTCAGGC TGGAGGCACCTTACTCACTCTTACTGGGAATACCTCAACAGTGGCAATTCTAGACACATTTCAA TTGGAGGGAAACATGTACTTTAAAAAGTGTATCAGATAGTATTCTTGAATGCTACACCCCAGCC CAAACTACCTCTGATGAGTTTCCTGTGAAATTGAAGATTGACTTGGCTAACCGAGAGACCAGCAG CTTCAGTTACCGGGAAGACCCCGTTGTCTATGAAATCCACCCGACCAAATCTTTTATTAGTGGTG GAAGCACAATAACGGGTATTGGGAAGACCCTGAACTCGGTTAGCCTCCCAAAGCTGGTAATAGAT GTGCATGAAGTGGGTGTGAACTACACAGTGGCATGTCAGCATCGCTCAAATTCAGAGATCATCTG CTGCACTACTCCTCACTGAAACAGCTGGGCCTGCAACTCCCCCTGAAGACCAAAGCCTTCTTCC TGTTAGACGGGATTCTTTCCAAACACTTTGATCTCACTTATGTGCATAATCCTGTGTTTGAGCCT TTTGAAAAGCCAGTAATGATCTCAATGGGCAATGAAAATGTAGTGGAAATTAAGGGAAACAATAT TGACCCTGAAGCAGTTAAAGGTGAAGTGTTAAAAGTTGGAAATCAGAGCTGCGAGAGTCTCCACT GGCACTCTGGAGCTGTGTTGTGTACAGTCCCCAGTGACCTGCTCAAACTGAACAGCGAGCTAAAT ATAGAGTGGAAGCAAGCAGTCTCTTCAACTGTTCTTGGAAAAGTGATCGTTCAACCGGATCAGAA TTTTGCAGGATTGATCATTGGTGCGGTCTCAATATCAGTAGTAGTTTTGTTATTATCCGGGCTCT TCCTGTGGATGAGAAAGAAAGCATAAAAGATCTGGGCAGTGAATTAGTTCGCTATGACGCAAGA GTACACACTCCTCATTTGGATAGGCTTGTAAGTGCCCGAAGTGTAAGTCCAACTACAGAGATGGT TTCAAATGAGTCTGTAGACTACAGAGTACTTTTCCAGAAGACCAGTTTCCCAACTCCTCTCAGA ATGGAGCATGCAGAAGTGCAATACCCCTCTGACAGACCTGTCCCCATCCTGACAAGTGGAGAC TCTGATATATCCAGCCCATTACTACAAAATACTGTTCACATTGACCTCAGTGCTCTAAATCCAGA GCTGGTCCAAGCAGTTCAGCACGTAGTGATTGGACCCAGCAGCCTGATTGTGCATTTCAATGAAG TCATAGGAAGAGGGCATTTTGGCTGTGTCTATCATGGGACTTTGCTGGACAATGACGGAAAGAA |

| SEQ ID NO. | DESIGNATION | SOURCE | TYPE | SEQUENCE |
|---|---|---|---|---|
| | | | | ATTCACTGTGCTGTGAAATCCTTAAATAGAATCACAGATATAGAAGAGGTCTCCCAGTTTCTGAC<br>TGAGGGAATCATCATGAAAGACTTCAGCCATCCCAATGTTCTCTCACTCTTGGGAATCTGCCTGA<br>GGAGTGAAGGGTCTCCTCTGGTGGTCCTGCCCTATATGAAGCATGGAGATCTGCGAAATTTCATT<br>CGAAACGAGACTCATAATCCAACTGTGAAAGATCTTATAGGATTTGGCCTTCAAGTAGCCAAAGG<br>CATGAAATATCTTGCCAGCAAAAAGTTTGTCCACAGAGACTTAGCTGCAAGAAACTGCATGTTGG<br>ATGAAAAATTCACTGTCAAGGTTGCTGATTTCGGTCTTGCCAGAGACATGTACGATAAAGAGTAC<br>TATAGTGTCCACAACAAGACGGGTGCCAAGCTACCAGTAAAGTGGATGGCTTTAGAGAGTCTGCA<br>AACGCAGAAGTTCACCACCAAGTCAGATGTGTGGTCCTTTGGTGTGCTCCTCTGGGAGCTCATGA<br>CGAGAGGAGCCCCTCCTTATCCCGACGTGAACACATTTGATATCACTATCTACCTGTTGCAAGGC<br>AGAAGACTCTTGCAACCAGAATACTGTCCAGACGCCTTGTACGAAGTGATGCTAAAATGCTGGCA<br>CCCCAAAGCGGAAATGCGCCCGTCCTTTTCCGAACTGGTCTCCAGGATATCCTCAATCTTCTCCA<br>CGTTCATTGGGGAACACTACGTCCACGTGAACGCTACTTATGTGAATGTAAAATGTGTTGCTCCA<br>TATCCTTCTCTGTTGCCATCCCAAGACAACATTGATGGCGAGGGGAACACATGA |
| 391. | murine C-MET construct | artificial | aa | MGWSCIILFLVATATGVHSDYKDDDDKECKEALVKSEMNVNMKYQLPNFTAETPIQNVVLHGHHI<br>YLGATNYIYVLNDKDLQKVSEFKTGPVLEHPDCLPCRDCSSKANSSGGVWKDNINMALLVDTYYD<br>DQLISCGSVNRGTCQRHVLPPDNSADIQSEVHCMFSPEEESGQCPDCVVSALGAKVLLSEKDRFI<br>NFFVGNTINSSYPPGYSLHSISVRRLKETQDGFKFLTDQSYIDVLPEFQDSYPIKYIHAFESNHF<br>IYFLTVQKETLDAQTFHTRIIRFCSVDSGLHSYMEMPLECILTEKRRKRSTREEVFNILQAAYVS<br>KPGANLAKQIGASPSDDILFGVFAQSKPDSAEPVNRSAVCAFPIKYVNDFFNKIVNKNNVRCLQH<br>FYGPNHEHCFNRTLLRNSSGCEARSDEYRTEFTTALQRVDLFMGRLNQVLLTSISTFIKGDLTIA<br>NLGTSEGRFMQVVLSRTAHLTPHVNFLLDSHPVSPEVIVEHPSNQNGYTLVVTGKKITKIPLNGL<br>GCGHFQSCSQCLSAPYFIQCGWCHNQCVRFDECPSGTWTQEICLPAVYKVFPTSAPLEGGTVLTI<br>CGWDFGFRKNNKFDLRKTKVLLGNESCTLTLSESTTNTLKCTVGPAMSEHFNVSVIISNSRETTQ<br>YSAFSYVDPVITSISPRYGPQAGGTLLTLTGKYLNSGNSRHISIGGKTCTLKSVSDSILECYTPA<br>QTTSDEFPVKLKIDLANRETSSFSYREDPVVYEIHPTKSPISGGSTITGIGKTLNSVSLPKLVID<br>VHEVGVNYTVACQHRSNSEIICCTTPSLKQLGLQLPLKTKAFFLLDGILSKHFDLTYVHNPVFEP<br>FEKPVMISIGNENVVEIKGNNIDPEAVKGEVLKVGNQSCESLHWHSGAVLCTVPSDLLKLNSELN<br>IEWKQAVSSTVLGKVIVQPDQNFAGLIIGAVSISVVVLLLSGLFLWMRKRKHKDLGSELVRYDAR<br>VHTPHLDRLVSARSVSPTTEMVSNESVDYRATFPEDQFPNSSQNGACRQVQYPLTDLSPILTSGD<br>SDISSPLLQNTVHIDLSALNPELVQAVQHVVIGPSSLIVHFNEVIGRGHFGCVYHGTLLDNDGKK<br>IHCAVKSLNRITDIEEVSQFLTEGIIMKDFSHPNVLSLLGICLRSEGSPLVVLPYMKHGDLRNFI<br>RNETHNPTVKDLIGFGLQVAKGMKYLASKKFVHRDLAARNCMLDEKFTVKVADFGLARDMYDKEY<br>YSVHNKTGAKLPVKWMALESLQTQKFTTKSDVWSFGVLLWELMTRGAPPYPDVNTFDITIYLLQG<br>RRLLQPEYCPDALYEVMLKCWHPKAEMRPSFSELVSRISSIFSTFIGEHYVHVNATYVNVKCVAP<br>YPSLLPSQDNIDGEGNT |
| 392. | mutated human C-MET antigen | artificial | nt | ATGGGATGGAGCTGTATCATCCTCTTCTTGGTAGCAACAGCTACAGGTGTACACTCCGATTACAA<br>GGACGACGATGACAAGGAGTGCAAGGAGGCCCTAGTGAAGTCTGAGATGAACGTGAACATGAAGT<br>ATCAGCTCCCCAACTTCACGGCAGAAACCCCCATCCAGAATGTCGTCCTACACGGCCATCATATT<br>TATCTCGGAGCCACAAACTACATTTATGTTTAAATGACAAAGACCTTCAGAAGGTATCCGAGTT<br>CAAGACCGGGCCCGTGTTGGAACACCCAGATTGTTTACCTTGTCGGGACTGCAGCAGCAAAGCCA<br>ATTCATCAGGAGGGGTTTGGAAAGACAATGAGATCAATGGCTCTGCTTGTTGACACATACTATGAT<br>GATCAACTCATTAGCTGTGGCAGTGTCAACAGAGGGACTTGCCAGCGGCATGTCCTTCCTCCTGA<br>CAATTCTGCTGACATCCAGTCTGAGGTCCACTGCATGTTCTCCCCAGAAGAGGAGTCAGGGCAGT<br>GTCCTGACTGTGTAGTGAGTGCCCTCGGAGCCAAAGTCCTCCTGTCGGAAAAGGACCGGTTCATC<br>AATTTCTTTGTGGGGAATACGATCAATTCCTCCTACCCTCCTGGTTATTCACTGCATTCGATATC<br>GGTGAGACGGCTGAAGGAAACCCAAGATGGTTTAAGTTTTTGACAGACCAGTCCTATATTGATG<br>TCTTACCAGAGTTCCAAGATTCCTACCCCATAAAGTACATACATGCCTTCGAAAGCAACCATTTT<br>ATTTACTTTCTGACTGTCCAAAAGGAAACTCTAGATGCTCAGACTTTTCATACAAGAATAATCAG<br>GTTCTGTTCCGTAGACTCTGGGTTGCACTCCTACATGGAAATGCCCCTGGAATGCATCCTGACAG<br>AAAAAAGAAGGAAGAGATCCACAAAGAAGGAAGTGTTTAATATACTTCAGGCTGCGTATGTCAGC<br>AAGCCTGGGGCCCAGCTTGCTAGACAAATAGGAGCCAGCTGAATGATGACATTCTTTTCGGGGT<br>GTTCGCACAAAGCAAGCCAGATTCTGCCGAACCAATGGATCGATCTGCCATGTGTGCATTCCCTA<br>TCAAATATGTCAACGACTTCTTCAACAAAATCGTCAACAAAAACAATGTGAGATGTCTCCAGCAT<br>TTTTACGGACCCAATCATGAGCACTGCTTTAATAGGACACTTCTGAGAAATTCATCAGGCTGTGA<br>AGCGCGCCGTGATGAATATCGAACAGAGTTTACCACAGCTTTGCAGCGCGTTGACTTATTCATGG<br>GTCAATTCAGCGAAGTCCTCTTAACATCTATATCCACCTTCATTAAAGGAGACCTCACCATAGCT<br>AATCTTGGGACATCAGAGGGTCGCTTCATGCAGGTTGTGGTTTCTCGATCAGGACCATCAACCCC<br>TCATGTGAATTTTCTCCTGGACTCCCATCCAGTGTCTCCAGAAGTGATTGTGGAGCATACATTAA<br>ACCAAAATGGCTACACACTGGTTATCACTGGGAAGAAGATCACGAAGATCCCATTGAATGGCTTG<br>GGCTGCAGACATTTCCAGTCCTGCAGTCAATGCCTCTCTGCCCCACCCTTTGTTCAGTGTGGCTG<br>GTGCCACGACAAATGTGTGCGATCGGAGGAATGCCTGAGCGGGACATGGACTCAACAGATCTGTC<br>TGCCTGCAATCTACAAGGTTTTCCCAAATAGTGCACCCCTTGAAGGAGGGACAAGGCTGACCATA<br>TGTGGCTGGGACTTTGGATTTCGGAGGAATAATAAATTTGATTTAAAGAAAACTAGAGTTCTCCT<br>TGGAAATGAGAGCTGCACCTTGACTTTAAGTGAGAGCACGATGAATACATTGAAATGCACAGTTG<br>GTCCTGCCATGAATAAGCATTTCAATATGTCATAATTATTTCAAATGGCCACGGGACAACACAA<br>TACAGTACATTCTCCTATGTGGATCCTGTAATAACAAGTATTTCGCCGAAATACGGTCCTATGGC<br>TGGTGGCACTTTACTTACTTTAACTGGAAATTACCTAAACAGTGGGAACTCTAGACACATTTCAA<br>TTGGTGGAAAAACATGTACTTTAAAAAGTGTGTCAAACAGTATTCTTGAATGTTATACCCCAGCC<br>CAAACCATTTCAACTGAGTTTGCTGTTAAATTGAAAATTGACTTAGCCAACCGAGAGACAAGCAT<br>CTTCAGTTACCGTGAAGATCCCATTGTCTATGAAATTCATCCAACCAAATCTTTTATTAGTGGTG<br>GGAGCACAATAACAGGTGTTGGGAAAAACCTGAACTCAGTTAGTGTCCCGAGAATGGTCATAAAT<br>GTGCATGAAGCAGGAAGGAACTTTACAGTGGCATGTCAACATCGCTCTAATTCAGAGATAATCTG<br>TTGTACCACTCCTTCCCTGCAACAGCTGAATCTGCAACTCCCCCTGAAAACCAAAGCCTTTTTCA |

| SEQ ID NO. | DESIGNATION | SOURCE | TYPE | SEQUENCE |
|---|---|---|---|---|
| | | | | TGTTAGATGGGATCCTTTCCAAATACTTTGATCTCATTTATGTACATAATCCTGTGTTTAAGCCT<br>TTTGAAAAGCCAGTGATGATCTCAATGGGCAATGAAATGTACTGGAAATTAAGGGAAATGATAT<br>TGACCCTGAAGCAGTTAAAGGTGAAGTGTTAAAAGTTGGAAATAAGAGCTGTGAGAATATACACT<br>TACATTCTGAAGCCGTTTTATGCACGGTCCCCAATGACCTGCTGAAATTGAACAGCGAGCTAAAT<br>ATAGAGTGGAAGCAAGCAATTTCTTCAACCGTCCTTGGAAAAGTAATAGTTCAACCAGATCAGAA<br>TTTCACAGGATTGATTGCTGGTGTTGTCTCAATATCAACAGCACTGTTATTACTACTTGGGTTTT<br>TCCTGTGGCTGAAAAGAGAAAGCAAATTAAAGATCTGGGCAGTGAATTAGTTCGCTACGATGCA<br>AGAGTACACACTCCTCATTTGGATAGGCTTGTAAGTGCCCGAAGTGTAAGCCCAACTACAGAAAT<br>GGTTTCAAATGAATCTGTAGACTACCGAGCTACTTTTCCAGAAGATCAGTTTCCTAATTCATCTC<br>AGAACGGTTCATGCCGACAAGTGCAGTATCCTCTGACAGACATGTCCCCCATCCTAACTAGTGGG<br>GACTCTGATATATCCAGTCCATTACTGCAAAATACTGTCCACATTGACCTCAGTGCTCTAAATCC<br>AGAGCTGGTCCAGGCAGTGCAGCATGTAGTGATTGGGCCCAGTAGCCTGATTGTGCATTTCAATG<br>AAGTCATAGGAAGAGGGCATTTTGGTTGTGTATATCATGGGACTTTGTTGGACAATGATGGCAAG<br>AAAATTCACTGTGCTGTGAAATCCTTGAACAGAATCACTGACATAGGAGAAGTTTCCCAATTTCT<br>GACCGAGGGAATCATCATGAAAGATTTTAGTCATCCCAATGTCCTCTCGCTCCTGGGAATCTGCC<br>TGCGAAGTGAAGGGTCTCCGCTGGTGGTCCTACCATACATGAAACATGGAGATCTTCGAAATTTC<br>ATTCGAAATGAGACTCATAATCCAACTGTAAAAGATCTTATTGGCTTTGGTCTTCAAGTAGCCAA<br>AGGCATGAAATATCTTGCAAGCAAAAAGTTTGTCCACAGAGACTTGGCTGCAAGAAACTGTATGC<br>TGGATGAAAAATTCACAGTCAAGGTTGCTGATTTTGGTCTTGCCAGAGACATGTATGATAAAGAA<br>TACTATAGTGTACACAACAAACAGGTGCAAAGCTGCCAGTGAAGTGGATGGCTTTGGAAAGTCT<br>GCAAACTCAAAAGTTTACCACCAAGTCAGATGTGTGGTCCTTTGGCGTCGTCCTCTGGGAGCTGA<br>TGACAAGAGGAGCCCCACCTTATCCTGACGTAAACACCTTTGATATAACTGTTTACTTGTTGCAA<br>GGGAGAAGACTCCTACAACCCGAATACTGCCCAGACCCCTTATATGAAGTAATGCTAAAATGCTG<br>GCACCCTAAAGCCGAAATGCGCCCATCCTTTTCTGAACTGGTGTCCCGGATATCAGCGATCTTCT<br>CTACTTTCATTGGGGAGCACTATGTCCATGTGAACGCTACTTATGTGAACGTAAATGTGTCGCT<br>CCGTATCCTTCTCTGTTGTCATCAGAAGATAACGCTGATGATGAGGTGGACACACGACCAGCCTC<br>CTTCTGGGAGACATCATAG |
| 393. | mutated human<br>C-MET antigen | artificial | aa | MGWSCIILFLVATATGVHSDYKDDDDKECKEALVKSEMNVNMKYQLPNFTAETPIQNVVLHGHHI<br>YLGATNYIYVLNDKDLQKVSEFKTGPVLEHPDCLPCRDCSSKANSSGGVWKDNINMALLVDTYYD<br>DQLISCGSVNRGTCQRHVLPPDNSADIQSEVHCMFSPEEESGQCPDCVVSALGAKVLLSEKDRFI<br>NFFVGNTINSSYPPGYSLHSISVRRLKETQDGFKFLTDQSYIDVLPEFQDSYPIKYIHAFESNHF<br>IYFLTVQKETLDAQTFHTRIIRFCSVDSGLHSYMEMPLECILTEKRRKRSTKKEVFNILQAAYVS<br>KPGAQLARQIGASLNDDILFGVFAQSKPDSAEPMDRSAMCAFPIKYVNDFFNKIVNKNNVRCLQH<br>FYGPNHEHCFNRTLLRNSSGCEARRDEYRTEFTTALQRVDLFMGQFSEVLLTSISTFIKGDLTIA<br>NLGTSEGRFMQVVVSRSGPSTPHVNFLLDSHPVSPEVIVEHTLNQNGYTLVITGKKITKIPLNGL<br>GCRHFQSCSQCLSAPPFVQCGWCHDKCVRSEECLSGTWTQQICLPAIYKVFPNSAPLEGGTRLTI<br>CGWDFGFRRNNKFDLKKTRVLLGNESCTLTLSESTMNTLKCTVGPAMNKHFNMSIIISNGHGTTQ<br>YSTFSYVDPVITSISPKYGPMAGGTLLTLTGNYLNSGNSRHISIGGKTCTLKSVSNSILECYTPA<br>QTISTEFAVKLKIDLANRETSIFSYREDPIVYEIHPTKSFISGGSTITGVGKNLNSVSVPRMVIN<br>VHEAGRNFTVACQHRSNSEIICCTTPSLQQLNLQLPLKTKAFFMLDGILSKYFDLIYVHNPVFKP<br>FEKPVMISMGNENVLEIKGNDIDPEAVKGEVLVKGNKSCENIHLHSEAVLCTVPNDLLKLNSELN<br>IEWKQAISSTVLGKVIVQPDQNFTGLIAGVVSISTALLLLLGFFLWLKKRKQIKDLGSELVRYDA<br>RVHTPHLDRLVSARSVSPTTEMVSNESVDYRATFPEDQFPNSSQNGSCRQVQYPLTDMSPILTSG<br>DSDSSPLLQNTVHIDLSALNPELVQAVQHVVIGPSSLIVHFNEVIGRGHFGCVYHGTLLDNDGK<br>KIHCAVKSLNRITDIGEVSQFLTEGIIMKDFSHPNVLSLLGICLRSEGSPLVVLPYMKHGDLRNF<br>IRNETHNPTVKDLIGFGLQVAKGMKYLASKKFVHRDLAARNCMLDEKFTVKVADFGLARDMYDKE<br>YYSVHNKTGAKLPVKWMALESLQTQKFTTKSDVWSFGVVLWELMTRGAPPYPDVNTFDITVYLLQ<br>GRRLLQPEYCPDPLYEVMLKCWHPKAEMRPSFSELVSRISAIFSTFIGEHYVHVNATYVNVKCVA<br>PYPSLLSSEDNADDEVDTRPASFWETS |
| 394. | mutated murine<br>C-MET antigen | artificial | nt | ATGGGATGGAGCTGTATCATCCTCTTCTTGGTAGCAACAGCTACAGGTGTACACTCCGATTACAA<br>GGACGACGATGACAAGGAGTGTAAAGAGGCACTAGCAAAGTCCGAGATGAATGTGAATATGAAGT<br>ATCAGCTTCCCAACTTCACCGCGGAAACACCCATCCAGAATGTCATTCTACATGAGCATCACATT<br>TTCCTTGGTGCCACTAACTACATTTATGTTTTAAATGAGGAAGACCTTCAGAAGGTTGCTGAGTA<br>CAAGACTGGGCCTGTGCTGGAACACCCAGATTGTTTCCCATGTCAGGACTGCAGCAGCAAAGCCA<br>ATTTATCAGGAGGTGTTTGGAAAGATAACATCAACATGGCTCTAGTTGTCGATACCTACTATGAT<br>GATCAACTCATTAGCTGTGGCAGCGTCAACAGAGGGACCTGCCAGCGACATGTCTTTCCCCACAA<br>TCATACTGCTGACATACAGTCGGAGGTTCACTGCATATTCTCCCCACAGATAGAAGAGCCCAGCC<br>AGTGTCCTGACTGTGTGGTGAGCGCCCTGGGAGCCAAAGTCCTTTCATCTGTAAAGGACCGGTTC<br>ATCAACTTCTTTGTAGGCAATACCATAAATTCTTCTTATTTCCCAGATCATCCATTGCATTCGAT<br>ATCAGTGAGAAGGCTAAAGGAAACGAAAGATGGTTTTATGTTTTTGACGGACCAGTCCTACATTG<br>ATGTTTTACCTGAGTTCAGAGATTCTTACCCCATTAAGTATGTCCATGCCTTTGAAAGCAACAAT<br>TTTATTTACTTCTTGACGGTCCAAAGGGAAACTCTAGATGCTCAGACTTTTCACACAAGAATAAT<br>CAGGTTCTGTTCCATAAACTCTGGATTGCATTCCTACATGGAAATGCCTCTGGAGTGTATTCTCA<br>CAGAAAAGAGAAAAAGAGATCCACAAGGGAAGAAGTGTTTAATATCCTCCAAGCCGCGTATGTC<br>AGTAAACCAGGGGCCAATCTTGCTAAGCAAATAGGAGCTAGCCCTTCTGATGACATTCTCTTCGG<br>GGTGTTTGCACAAAGCAAGCCAGATTCTGCTGAACCTGTGAATCGATCAGCAGTCTGTGCATTCC<br>CCATCAAATATGTCAATGACTTCTTCAACAAGATTGTCAACAAAAACAACGTGAGATGTCTCCAG<br>CATTTTTACGGACCCAACCATGAGCACTGTTTCAATAGGACCCTGCTGAGAAACTCTTCCGGCTG<br>TGAAGCGCGCAGTGACGAGTATCGGACAGAGTTTACCACGGCTTTGCAGCGCGTCGATTATTCA<br>TGGGCCGGCTTAACCAAGTGCTCCTGACATCCATCTCCACCTTCATCAAAGGTGACCTCACCATT<br>GCTAATCTAGGGACGTCAGAAGGTCGCTTCATGCAGGTGGTGCTCTCGAACAGCACACCTCAC<br>TCCTCATGTGAACTTCCTCCTGGACTCCCATCCTGTATCTCCAGAAGTTATTGTTGAGCATCCAT<br>CAAATCAAAATGGCTATACATTGGTTGTCACAGGAAAGAAGATCACCAAGATTCCATTGAATGGC |

| SEQ ID NO. | DESIGNATION | SOURCE | TYPE | SEQUENCE |
|---|---|---|---|---|
| | | | | CTGGGCTGTGGACATTTCCAATCCTGCAGTCAGTGCCTCTCTGCCCCTTACTTTATACAGTGTGG
CTGGTGCCACAATCAATGTGTGCGTTTTGATGAATGCCCCAGCGGTACATGGACTCAAGAGATCT
GTCTGCCGGCGGTTTATAAGGTGTTCCCCACCAGCGCGCCCCTTGAAGGAGGAACAGTGTTGACC
ATATGTGGCTGGGACTTTGGATTCAGGAAGAATAATAAATTTGATTTAAGGAAAACCAAAGTTCT
GCTTGGCAACGAGAGCTGTACCTTGACCTTAAGCGAGAGCACGACAAATACGTTGAAATGCACAG
TTGGTCCCGCGATGAGTGAGCACTTCAATGTGTCTGTAATTATCTCAAACAGTCGAGAGACGACG
CAATACAGTGCATTCTCCTATGTAGATCCTGTAATAACAAGCATTTCTCCGAGGTACGGCCCTCA
GGCTGGAGGCACCTTACTCACTCTTACTGGGAAATACCTCAACAGTGGCAATTCTAGACACATTT
CAATTGGAGGGAAAACATGTACTTTAAAAAGTGTATCAGATAGTATTCTTGAATGCTACACCCCA
GCCCAAACTACCTCTGATGAGTTTCCTGTGAAATTGAAGATTGACTTGGCTAACCGAGAGACCAG
CAGCTTCAGTTACCGGGAAGACCCCGTTGTCTATGAAATCCACCCGACCAAATCTTTTATTAGTG
GTGGAAGCACAATAACGGGTATTGGGAAGACCCTGAACTCGGTTAGCCTCCCAAAGCTGGTAATA
GATGTGCATGAAGTGGGTGTGAACTACACAGTGGCATGTCAGCATCGCTCAAATTCAGAGATCAT
CTGCTGCACTACTCCTTCACTGAAACAGCTGGGCCTGCAACTCCCCTGAAGACCAAAGCCTTCT
TCCTGTTAGACGGGATTCTTTCCAAACACTTTGATCTCACTTATGTGCATAATCCTGTGTTTGAG
CCTTTTGAAAAGCCAGTAATGATCTCAATAGGCAATGAAATGTAGTGGAAATTAAGGGAAACAA
TATTGACCCTGAAGCAGTTAAAGGTGAAGTGTTAAAAGTTGGAAATCAGAGCTGCGAGAGTCTCC
ACTGGCACTCTGGAGCTGTGTTGTGTACAGTCCCCAGTGACCTGCTCAAACTGAACAGCGAGCTA
AATATAGAGTGGAAGCAAGCAGTCTCTTCAACTGTTCTTGGAAAAGTGATCGTTCAACCGGATCA
GAATTTTGCAGGATTGATCATTGGTGCGGTCTCAATATCAGTAGTAGTTTTGTTATTATCCGGGC
TCTTCCTGTGGATGAGAAAGAGAAAGCATAAAGATCTGGGCAGTGAATTAGTTCGCTATGACGCA
AGAGTACACACTCCTCATTTGGATAGGCTTGTAAGTGCCCGAAGTGTAAGTCCAACTACAGAGAT
GGTTTCAAATGAGTCTGTAGACTACAGAGCTACTTTTCCAGAAGACCAGTTTCCCAACTCCTCTC
AGAATGGAGCATGCAGACAAGTCAATACCCTGACAGACCTGTCCCTATCCTGACAAGTGGA
GACTCTGATATATCCAGCCCATTACTACAAAATACTGTTCACATTGACCTCAGTGCTCTAAATCC
AGAGCTGGTCCAAGCAGTTCAGCACGTAGTGATTGGACCCAGCAGCCTGATTGTGCATTTCAATG
AAGTCATAGGAAGAGGGCATTTTGGCTGTGTCTATCATGGGACTTTGCTGGACAATGACGGAAAG
AAAATTCACTGTGCTGTGAAATCCTTAAATAGAATCACAGATATAGAAGAGGTCTCCCAGTTTCT
GACTGAGGGAATCATCATGAAAGACTTCAGCCATCCCAATGTTCTCTCACTCTTGGGAATCTGCC
TGAGGAGTGAAGGGTCTCCTCTGGTGGTCCTGCCCTATATGAAGCATGGAGATCTGCGAAATTTC
ATTCGAAACGAGACTCATAATCCAACTGTGAAAGATCTTATAGGATTTGGCCTTCAAGTAGCCAA
AGGCATGAAATATCTTGCCAGCAAAAGTTTGTCCACAGAGACTTAGCTGCAAGAACTGCATGT
TGGATGAAAAATTCACTGTCAAGGTTGCTGATTTCGGTCTTGCCAGAGACATGTACGATAAAGAG
TACTATAGTGTCCACAACAAGACGGGTGCCAAGCTACCAGTAAAGTGGATGGCTTTAGAGAGTCT
GCAAACGCAGAAGTTCACCACCAAGTCAGATGTGTGGTCCTTTGGTGTGCTCCTCTGGGAGCTCA
TGACGAGAGGAGCCCCTCCTTATCCCGACGTGAACACATTTGATATCACTATCTACCTGTTGCAA
GGCAGAAGACTCTTGCAACCAGAATACTGTCCAGACGCCTTGTACGAAGTGATGCTAAAATGCTG
GCACCCCAAAGCGGAAATGCGCCCGTCCTCCTTTTCCGAACTGGTCTCCAGGATATCCTCAATCTTCT
CCACGTTCATTGGGGAACACTACGTCCACGTGAACGCTACTTATGTGAATGTAAAATGTTGCT
CCATATCCTTCTCTGTTGCCATCCCAAGCAACATTGATGGCGAGGGGAACACATGA |
| 395. | mutated murine C-MET antigen | artificial | aa | MGWSCIILFLVATATGVHSDYKDDDDKECKEALAKSEMNVNMKYQLPNFTAETPIQNVILHEHHI
FLGATNYIYVLNEEDLQKVAEYKTGPVLEHPDCFPCQDCSSKANLSGGVWKDNINMALVVDTYYD
DQLISCGSVNRGTCQRHVFPHNHTADIQSEVHCIFSPQIEEPSQCPDCVVSALGAKVLSSVKDRF
INFFVGNTINSSYFPDHPLHSISVRRLKETKDGFMFLTDQSYIDVLPEFRDSYPIKYVHAFESNN
FIYFLTVQRETLDAQTFHTRIIRFCSINSGLHSYMEMPLECILTEKRKKRSTREEVFNILQAAYV
SKPGANLAKQIGASPSDDILFGVFAQSKPDSAEPVNRSAVCAFPIKYVNDFFNKIVNKNNVRCLQ
HEYGPNHEHCFNRTLLRNSSGCEARSDEYRTEFTTALQRVDLFMGRLNQVLLTSISTFIKGDLTI
ANLGTSEGRFMQVVLSRTAHLTPHVNFLLDSHPVSPEVIVEHPSNQNGYTLVVTGKKITKIPLNG
LGCGHFQSCSQCLSAPYFIQCGWCHNQCVRFDECPSGTWTQEICLPAVYKVFPTSAPLEGGTVLT
ICGWDFGFRKNNKFDLRKTKVLLGNESCTLTLSESTTNTLKCTVGPAMSEHFNVSVIISNSRETT
QYSAFSYVDPVITSISPRYGPQAGGTLLLTLTGKYLNSGNSRHISIGGKTCTLKSVSDSILECYTP
AQTTSDEFPVKLKIDLANRETSSFSYREDPVVYEIHPTKSFISGGSTITGIKTLNSVSLPKLVI
DVHEVGVNYTVACQHRSNSEIICCTTPSLKQLGLQLPLKTKAFFLLDGILSKHFDLTYVHNPVFE
PFEKPVMISIGNENVVEIKGNNIDPEAVKGEVLKVGNQSCESLHWHSGAVLCTVPSDLLKLNSEL
NIEWKQAVSSTVLGKVIVQPDQNFAGLIIGAVSISVVVLLLSGLFLWMRKRKHKDLGSELVRYDA
RVHTPHLDRLVSARSVSPTTEMVSNESVDYRATFPEDQFPNSSQNGACRQVQYPLTDLSPILTSG
DSDISSPLLQNTVHIDLSALNPELVQAVQHVVIGPSSLIVHFNEVIGRGHFGCVYHGTLLDNDGK
KIHCAVKSLNRITDIEEVSQFLTEGIIMKDFSHPNVLSLLGICLRSEGSPLVVLPYMKHGDLRNF
IRNETHNPTVKDLIGFGLQVAKGMKYLASKKFVHRDLAARNCMLDEKFTVKVADFGLARDMYDKE
YYSVHNKTGAKLPVKWMALESLQTQKFTTKSDVWSFGVLLWELMTRGAPPYPDVNTFDITIYLLQ
GRRLLQPEYCPDALYEVMLKCWHPKAEMRPSFSELVSRISSIFSTFIGEHYVHVNATYVNVKCVA
PYPSLLPSQDNIDGEGNT |
| 396. | macaque C-MET forward primer | artificial | nt | AGGAATTCACCATGAAGGCCCCCGCTGTGCTTGCACC |
| 397. | macaque C-MET reverse primer | artificial | nt | CTCCAGAGGCATTTCCATGTAGG |
| 398. | macaque C-MET forward primer | artificial | nt | GTCCAAAGGGAAACTCTAGATGC |
| 399. | macaque C-MET reverse primer | artificial | nt | GGAGACACTGGATGGGAGTCCAGG |

| SEQ ID NO. | DESIGNATION | SOURCE | TYPE | SEQUENCE |
|---|---|---|---|---|
| 400. | macaque C-MET forward primer | artificial | nt | CATCAGAGGGTCGCTTCATGCAGG |
| 401. | macaque C-MET reverse primer | artificial | nt | GCTTTGGTTTTCAGGGGAGTTGC |
| 402. | macaque C-MET forward primer | artificial | nt | ATCCAACCAAATCTTTTATTAGTGGTGG |
| 403. | macaque C-MET reverse primer | artificial | nt | GACTTCATTGAAATGCACAATCAGG |
| 404. | macaque C-MET forward primer | artificial | nt | TGCTCTAAATCCAGAGCTGGTCC |
| 405. | macaque C-MET reverse primer | artificial | nt | GTCAGATAAGAAATTCCTTAGAATCC |
| 406. | macaque C-MET | artificial | nt | ATGAAGGCCCCCGCTGTGCTTGCACCTGGCATCCTCGTGCTCCTGTTTACCTTGGTGCAGAGGAG CAATGGGGAGTGTAAAGAGGCACTAGCAAAGTCCGAGATGAATGTGAATATGAAGTATCAGCTTC CCAACTTCACCGCGGAAACAGCCATCCAGATGTCATTCTACATGAGCATCACATTTTCCTCGGT GCCACCAACTACATTTATGTTTAAATGAGGAAGACCTTCAGAAGGTTGCTGAGTACAAGACCGG GCCTGTGCTGGAACACCCAGATTGTTTCCCGTGTCAGGACTGCAGCAGCAAAGCCAATTTATCAG GAGGCGTTTGGAAAGATAACATCAACATGGCTCTGGTTGTGGACACCTACTATGATGATCAACTC ATTAGCTGTGGCAGCGTCAACAGAGGGACCTGCCAGCGACATGTCTTTCCCCATAATCATACTGC TGACATACAGTCGGAGGTTCACTGCATATTCTCCCCACAGATAGAAGAGCCCAACCAGTGCCCTG ACTGTGTGGTGAGCGCCCGGGAGCCAAAGTCCTTTCATCTGTAAAGGACCGGTTCATCAACTTC TTTGTAGGCAATACCATAAATTCTTCTTATTTCCCACATCATCCGTTGCATTCGATATCAGTGAG AAGGCTAAAGGAAACGAAAGATGGTTTTATGTTTTTGACAGACCAGTCCTACATTGATGTTTTAC CTGAGTTCAGAGATTCTTACCCCATTAAGTACATCCACGCTTTTGAAAGCAACAATTTTATTTAC TTCTTGACGGTCCAAAGGGAAACTCTAAATGCTCAGACTTTTCACACAAGAATAATCAGGTTCTG TTCCTTAAACTCTGGATTGCACTCCTACATGGAAATGCCTCTAGAGTGTATTCTCACAGAAAAGA GAAAAAGAGATCCACAAAGAAGGAAGTGTTTAATATCCTTCAGGCTGCATATGTCAGCAAGCCC GGGGCCCAGCTTGCTAGACAAATAGGAGCCAGCCTGAATGATGACATTCTCTTTGGGGTGTTCGC ACAAAGCAAGCCAGATTCTGCCGAACCAATGGATCGATCTGCAATGTGTGCATTTCCTATCAAAT ATGTCAACGACTTCTTCAACAAGATCGTCAACAAAAACAATGTGAGATGTCTCCAGCATTTTTAT GGACCCAATCATGAGCACTGTTTTAATAGGACACTTCTGAGAAATTCATCAGGCTGTGAAGCGCG CCGTGATGAATATCGAGCAGAGTTTACCACAGCTTTGCAGCGGGTTGACTTATTCATGGGTCAAT TCAGCGAAGTCCTCTTAACATCTATATCCACCTTCGTGAAAGGAGACCTCACCATCGCTAATCTT GGGACATCAGAGGGTCGCTTCATGCAGGTTGTGGTTTCTCGATCAGGACCATCAACCCCTCATGT GAATTTTCTCCTGGACTCTCACCCGGTGTCTCCAGAAGTGATTGTGGAGCATCCATTAAACCAGA ATGGCTACACACTGGTTGTCACGGGGAAGAAGATCACCAAGATCCCATTGAATGGCTTGGGCTGC AGACATTTCCAGTCCTGCAGTCAGTGCCTCTCTGCCCCACCCTTTGTGCAGTGTGGCTGGTGCCA CGACAAATGTGTGCGATCGGAGGAATGCCCCAGTGGGACATGGACTCAACAGATCTGTCTGCCTG CAATCTACAAGGTTTTCCCAACTAGTGCACCCCTTGAAGGAGGGACAAGGCTGACCATATGTGGC TGGGACTTTGGATTTCGGAGGAATAATAAATTTGATTTAAAGAAAACTAGAGTTCTCCTTGGAAA TGAGAGCTGCACCTTGACTTTAAGTGAGAGCACGATGAATACATTGAAATGCACAGTTGGTCCTG CCATGAATAAACATTTCAATATGTCCATAATTATTTCAAATGGCCACGGGACAACACAATACAGT ACATTTTCCTATGTGGATCCTATAATAACAAGTATTTCGCCAAAATATGGCCCTATGGCTGGTGG CACTTTACTTACTTTAACTGGAAATTACCTAAACAGTGGCAATTCTAGACACATTTCAATTGGTG GAAAAACATGTACTTTAAAAAGTGTGTCAAACAGTATTCTCGAATGTTATACCCCAGCCCAAACC ATTTCAACTGAGTTTGCTGTTAAATTGAAAATTGACTTAGCCAACCGAGAGACAAGCATCTTCAG TTACCGGGAAGACCCCATTGTCTATGAAATTCATCCAACCAAATCTTTTATTAGTGGTGGGAGCA CAATAACAGGTGTTGGGAAAAACCTGCATTCAGTTAGTGTCCCGAGGATGGTCATAAATGTGCAT GAAGCAGGAAGGAACTTTACAGTGGCATGTCAGCATCGCTCTAATTCAGAGATAATCTGCTGTAC CACTCCTTCCCTGCAACAGCTGAATCGCAACTCCCCCTGAAACCAAAGCCTTTTTCATGTTAG ATGGGATCCTTTCCAAATACTTTGATCTCATTTATGTACATAATCCTGTGTTTAAGCCTTTTGAA AAGCCAGTAATGATCTCAATGGGCAATGAAAATGTACTGGAAATTAAGGGAAATGATATTGACCC TGAAGCAGTTAAAGGTGAAGTGTTAAAAGTTGGAAATAAGAGCTGTGAGAATATACACTTACATT CTGAAGCCGTTTTATGCACGGTCCCCAATGACCTGCTGAAATTGAACAGCGAGCTAAATATAGAG TGGAAGCAAGCAATTTCTTCAACCGTCCTTGGAAAAGTAATAGTTCAACCAGATCAGAATTTCAC CGGATTGATTGCTGGTGTTGTCTCAATATCAATAGCACTCTTACTACTACTTGGGCTTTTCCTGT GGCTGAAAAAGAGAAAGCAAATTAAAGATCTGGGCAGTGAATTAGTTCGCTATGATGCAAGAGTA CACACTCCTCATTTGGATAGGCTTGTAAGTGCCCGAAGTGTAAGCCCAACAACAGAAATGGTTTC AAATGAATCTGTAGACTACCGAGCTACTTTTCCAGAAGATCAGTTTCCTAATTCATCTCAGAACG GTTCATGCCGACAAGTGCAGTATCCTCTGACAGACATGTCCCCATCCTGACTAGTGGGACTCT GATATATCCAGTCCATTACTGCAAAACACTGTCCACATTGACCTCAGCGCTCTAAATCCAGAGCT GGTCCAGGCAGTGCAGCATGTAGTGATTGGGCCCAGTAGCCTGATTGTGCATTTCAATGAAGTCA TAGGAAGAGGGCATTTTGGTTGTGTATATCATGGGACTTTGTTGGACAATGATGGCAAGAAAATT CACTGTGCTGTGAAATCCTTGAACAGAATCACTGACATAGGAGAAGTTTCCCAGTTTCTGACCGA GGGAATCATCATGAAAGATTTAGTCATCCCAATGTCCTCTCGCTCCTGGGAATCTGCCTGCGAA GTGAAGGGCTCTCCGCTGGTGGTCCTACCCTACATGAAACATGGAGATCTTGAAATTTCATTCGA AATGAGACTCATAATCCAACTGTAAAAGATCTTATTGGCTTTGGTCTTCAAGTAGCCAAAGGCAT GAAATATCTTGCAAGCAAAAGTTTGTCCACAGAGACTTGGCTGCAAGAAACTGTATGCTGGATG |

| SEQ ID NO. | DESIGNATION | SOURCE | TYPE | SEQUENCE |
|---|---|---|---|---|
| | | | | AAAAATTCACAGTCAAGGTTGCTGATTTTGGTCTTGCCAGAGACATGTATGATAAAGAATACTAT<br>AGTGTGCACAACAAAACAGGTGCAAAGCTGCCAGTGAAGTGGATGGCTTTGGAAAGTCTGCAAAC<br>TCAAAAGTTTACCACCAAGTCAGATGTGTGGTCCTTTGGTGTGCTCCTCTGGGAGCTCATGACAA<br>GAGGAGCCCCACCCTATCCTGATGTGAACACCTTTGATATAACTGTTTACTTGTTGCAAGGGAGA<br>AGGCTCCTACAACCCGAATACTGCCCAGACCCCTTTATATGAAGTAATGCTAAAATGCTGGCACCC<br>TAAAGCAGAAATGCGCCCATCCTTTTCTGAACTGGTGTCCCGGATATCAGCGATCTTCTCTACTT<br>TCATTGGGGAGCACTACGTCCATGTAAACGCTACTTATGTGAACGTAAATGTGTCGCTCCATAT<br>CCTTCTCTGTTGTCATCAGAAGATAACGCTGATGACGAGGTGGACACATGA |
| 407. | macaque C-MET | artificial | aa | MKAPAVLAPGILVLLFTLVQRSNGECKEALAKSEMNVNMKYQLPNFTAETAIQNVILHEHHIFLG<br>ATNYIYVLNEEDLQKVAEYKTGPVLEHPDCFPCQDCSSKANLSGGVWKDNINMALVVDTYYDDQL<br>ISCGSVNRGTCQRHVFPHNHTADIQSEVHCIFSPQIEEPNQCPDCVVSALGAKVLSSVKDRFINF<br>FVGNTINSSYFPHHPLHSISVRRLKETKDGFMFLTDQSYIDVLPEFRDSYPIKYIHAFESNNFIY<br>FLTVQRETLNAQTFHTRIIRFCSLNSGLHSYMEMPLECILTEKRKKRSTKKEVFNILQAAYVSKP<br>GAQLARQIGASLNDDILFGVFAQSKPDSAEPMDRSAMCAFPIKYVNDFFNKIVNKNNVRCLQHFY<br>GPNHEHCFNRTLLRNSSGCEARRDEYRAEFTTALQRVDLFMGQFSEVLLTSISTFVKGDLTIANL<br>GTSEGRFMQVVVSRSGPSTPHVNFLLDSHPVSPEVIVEHPLNQNGYTLVVTGKKITKIPLNGLGC<br>RHFQSCSQCLSAPPFVQCGWCHDKCVRSEECPSGTWTQQICLPAIYKVFPTSAPLEGGTRLTICG<br>WDFGFRRNNKFDLKKTRVLLGNESCTLTLSESTMNTLKCTVGPAMNKHFNMSIIISNGHGTTQYS<br>TFSYVDPIITSISPKYGPMAGGTLLTLTGNYLNSGNSRHISIGGKTCTLKSVSNSILECYTPAQT<br>ISTEFAVKLKIDLANRETSIFSYREDPIVYEIHPTKSFISGGSTITGVGKNLHSVSVPRMVINVH<br>EAGRNFTVACQHRSNSEIICCTTPSLQQLNLQLPLKTKAFFMLDGILSKYFDLIYVHNPVFKPFE<br>KPVMISMGNENVLEIKGNDIDPEAVKGEVLKVGNKSCENIHLHSEAVLCTVPNDLLKLNSELNIE<br>WKQAISSTVLGKVIVQPDQNFTGLIAGVVSISIALLLLLGLFLWLKKRKQIKDLGSELVRYDARV<br>HTPHLDRLVSARSVSPTTEMVSNESVDYRATFPEDQFPNSSQNGSCRQVQYPLTDMSPILTSGDS<br>DISSPLLQNTVHIDLSALNPELVQAVQHVVIGPSSLIVHFNEVIGRGHFGCVYHGTLLDNDGKKI<br>HCAVKSLNRITDIGEVSQFLTEGIIMKDFSHPNVLSLLGICLRSEGSPLVVLPYMKHGDLRNFIR<br>NETHNPTVKDLIGFGLQVAKGMKYLASKKFVHRDLAARNCMLDEKFTVKVADFGLARDMYDKEYY<br>SVHNKTGAKLPVKWMALESLQTQKFTTKSDVWSFGVLLWELMTRGAPPYPDVNTFDITVYLLQGR<br>RLLQPEYCPDPLYEVMLKCWHPKAEMRPSFSELVSRISAIFSTFIGEHYVHVNATYVNVKCVAPY<br>PSLLSSEDNADDEVDT |
| 408. | human Endosilain construct | artificial | nt | ATGCTGCTGCGCCTGTTGCTGGCCTGGGCGGCCGCAGGGCCCACACTGGGCCAGGACCCCTGGGC<br>TGCTGAGCCCCGTGCCGCCTGCGGCCCCAGCAGCTGCTACGCTCTCTTCCCACGGCGCCGCACCT<br>TCCTGGAGGCTTGGCGGGCCTGCCGCGAGCTGGGGGGCGACCTGGCCACTCCTCGGACCCCCGAG<br>GAGGGCCCAGCGTGTGGACAGCTGGTGGGTGCGGGCCCAGCCAGCCGGCTGCTGGATCGGGCT<br>GCAGCGGCAGGCCCGGCAATGCCAGCTGCAGCGCCCACTGCGCGGCTTCACGTGGACCACAGGGG<br>ACCAGGACACGGCTTTCACCAACTGGGCCCAGCCAGCCTCTGGAGGCCCCTGCCCGGCCCAGCGC<br>TGTGTGGCCCTGGAGGCAAGTGGCGAGCACGCTGGCTGGAGGGCTCGTGCACGCTGGCTGTCGA<br>CGGCTACCTGTGCCAGTTTGGCTTCGAGGGCGCCTGCCCGGCGCTGCAAGATGAGGCGGGCCAGG<br>CCGGCCCAGCCGTGTATACCACGCCCTTCCACCTGGTCTCCACAGAGTTTGAGTGGCTGCCCTTC<br>GGCTCTGTGGCCGCTGTGCAGTGCCAGGCTGGCAGGGGAGCCTCTCTGCTCTGCGTGAAGCAGCC<br>TGAGGGAGGTGTGGGCTGGTCACGGGCTGGGCCCCTGTGCCTGGGGACTGGCTGCAGCCCTGACA<br>ACGGGGGCTGCGAACACGAATGTGTGGAGGAGGTGGATGGTCACGTGTCCTGCCGCTGCACTGAG<br>GGCTTCCGGCTGGCAGCAGACGGGCGAGTTGCGAGGACCCCTGTGCCCAGGCTCCGTGCGAGCA<br>GCAGTGTGAGCCCGGTGGGCCACAAGGCTACAGCTGCCACTGTCGCCTGGGTTTCCGGCCAGCGG<br>AGGATGATCCGCACCGCTGTGTGGACACAGATGAGTGCCAGATTGCCGGTGTGTGCCAGCAGATG<br>TGTGTCAACTACGTTGGTGGCTTCGAGTGTTATTGTAGCGAGGGACATGAGCTGGAGGCTGATGG<br>CATCAGCTGCAGCCCTGCAGGGGCCATGGGTGCCCAGGCTTCCCAGGACCTCGGAGATGAGTTGC<br>TGGATGACGGGGAGGATGAGGAAGATGAAGACGAGGCCTGGAAGGCCTTCAACGGTGGCTGGACG<br>GAGATGCCTGGGATCCTGTGGATGGAGCCTACGCAGCCGCCTGACTTTGCCCTGGCCTATAGACC<br>GAGCTTCCAGAGGACAGAGAGCCACAGATACCCTACCCGGAGCCCACCTGGCCACCCCCGCTCA<br>GTGCCCCCAGGGTCCCCTACCACTCCTCAGTGCTCTCCGTCACCCGGCTGTGGTGGTCTCTGCC<br>ACGCATCCCACACTGCCTTCTGCCCACCAGCCTCCTGTGATCCCTGCCACACACCCAGCTTTGTC<br>CCGTGACCACCAGATCCCCGTGATCGCAGCCAACTATCCAGATCTGCCTTCTGCCTACCAACCCG<br>GTATTCTCTCTGTCTCTCATTCAGCACAGCTCCTGCCCACCAGCCCCTATGATCTCAACCAAA<br>TATCCGGAGCTCTTCCCTGCCCACCAGTCCCCATGTTTCCAGACACCCGGGTCGCTGGCACCCA<br>GACCACCACTCATTTGCCTGGAATCCCACCTAACCATGCCCCTCTGGTCACCACCCTCGGTGCCC<br>AGCTACCCCCTCAAGCCCCAGATGCCCTTGCCTCAGAACCCAGGCCACCCAGCTTCCCATTATC<br>CCAACTGCCCAGCCCTCTCTGACCACCACCTCCAGGTCCCCTGTGTCTCCTGCCCATCAAATCTC<br>TGTGCCTGCTGCCACCCAGCCCGCAGCCCTCCCCACCCTCCTGCCCTCTCAGAGCCCCACTAACC<br>AGACCTCACCCATCAGCCCTACACATCCCCATTCCAAAGCCCCCCAAATCCCAAGGGAAGATGGC<br>CCCAGTCCCAAGTTGGCCCTGTGGCTGCCCTCACCAGCTCCCACAGCAGCCCCAACAGCCCTGGG<br>GGAGGCTGGTCTTGCCGAGCACAGCCAGAGGGATGACCGGTGGCTGCTGGTGGCACTCCTGGTGC<br>CAACGTGTGTCTTTTTGGTGGTCCTGCTTGCACTGGGCATCGTGTACTGCACCCGCTGTGGCCCC<br>CATGCACCCAACAAGCGCATCACTGACTGCTATCGCTGGGTCATCCATGCTGGGAGCAAGAGCCC<br>AACAGAACCCATGCCCCCAGGGGCAGCCTCACAGGGGTGCAGACCTGCAGAACCAGCGTGGACT<br>ACAAAGATGATGACGATAAGTGA |
| 409. | human Endosilain construct | artificial | aa | MLLRLLLAWAAAGPTLGQDPWAAEPRAACGPSSCYALFPRRRTFLEAWRACRELGGDLATPRTPE<br>EAQRVDSLVGAGPASRLLWIGLQRQARQCQLQRPLRGFTWTTGDQDTAFTNWAQPASGGPCPAQR<br>CVALEASGEHRWLEGSCTLAVDGYLCQFGFEGACPALQDEAGQAGPAVYTTPFHLVSTEFEWLPF<br>GSVAAVQCQAGRGASLLCVKQPEGGVGWSRAGPLCLGTGCSPDNGGCEHECVEEVDGHVSCRCTE<br>GFRLAADGRSCEDPCAQAPCEQQCEPGGPQGYSCHCRLGFRPAEDDPHRCVDTDECQIAGVCQQM<br>CVNYVGGFECYCSEGHELEADGISCSPAGAMGAQASQDLGDELLDDGEDEEDEDEAWKAFNGGWT |

| SEQ ID NO. | DESIGNATION | SOURCE | TYPE | SEQUENCE |
|---|---|---|---|---|
| | | | | EMPGILWMEPTQPPDFALAYRPSFPEDREPQIPYPEPTWPPPLSAPRVPYHSSVLSVTRPVVVSA THPTLPSAHQPPVIPATHPALSRDHQIPVIAANYPDLPSAYQPGILSVSHSAQPPAHQPPMISTK YPELFPAHQSPMFPDTRVAGTQTTTHLPGIPPNHAPLVTTLGAQLPPQAPDALVLRTQATQLPII PTAQPSLTTTSRSPVSPAHQISVPAATQPAALPTLLPSQSPTNQTSPISPTHPHSKAPQIPREDG PSPKLALWLPSPAPTAAPTALGEAGLAEHSQRDDRWLLVALLVPTCVFLVVLLALGIVYCTRCGP HAPNKRITDCYRWVIHAGSKSPTEPMPPRGSLTGVQTCRTSVDYKDDDDK |
| 410. | soluble fusion protein of h Endosilain and m IgG1 Fc | artificial | nt | ATGCTGCTGCGCCTGTTGCTGGCCTGGGCGGCCGCAGGGCCCACACTGGGCCAGGACCCCTGGGC TGCTGAGCCCCGTGCCGCCTGCGGCCCCAGCAGCTGCTACGCTCTCTTCCCACGGCGCCGCACCT TCCTGGAGGCTGGCGGGCCTGCCGCGAGCTGGGGGGCGACCTGGCCACTCCTCGGACCCCCGAG GAGGGCCCAGCGTGTGGACAGCCTGGTGGGTGCGGGCCCAGCCAGCCGGCTGCTGTGGATCGGGCT GCAGCGGCAGGCCCGGCAATGCCAGCTGCAGCGCCCACTGCGCGGCTTCACGTGGACCACAGGGG ACCAGGACACGGCTTTCACCAACTGGGCCCAGCCAGCCTCTGGAGGCCCCTGCCCGGCCCAGCGC TGTGTGGCCCTGGAGGCAAGTGGCGAGCACCGCTGGCTGGAGGGTCGTGCACGCTGGCTGTCGA CGGCTACCTGTGCCAGTTTGGCTTCGAGGGCGCCTGCCCGGCGCTGCAAGATGAGGCGGGCCAGG CCGGCCCAGCCGTGTATACCACGCCCTTCCACCTGGTCTCCACAGAGTTTGAGTGGCTGCCCTTC GGCTCTGTGGCCGCTGTGCAGTGCCAGGCTGGCAGGGGAGCCTCTCTGCTCTGCGTGAAGCAGCC TGAGGGAGGTGTGGGCTGGTCACGGGCTGGGCCCTGTGCCTGGGGACTGGCTGCAGCCCTGACA ACGGGGGCTGCGAACACGAATGTGTGGAGGAGGTGGATGGTCACGTGTCCTGCCGCTGCACTGAG GGCTTCCGGCTGGCAGACGGGCGCAGTTGCGAGGACCCTGTGCCCAGGCTCCGTGCGAGCA GCAGTGTGAGCCCGGTGGGCCACAAGGCTACAGCTGCCACTGTCGCCTGGGTTTCCGGCCAGCGG AGGATGATCCGCACCGCTGTGTGGACACAGATGAGTGCCAGATTGCCGGTGTGTGCCAGCAGATG TGTGTCAACTACGTTGGTGGCTTCGAGTGTTATTGTAGCGAGGGACATGAGCTGGAGGCTGATGG CATCAGCTGCAGCCCTGCAGGGGCCATGGGTGCCCAGGCTTCCAGGACCTCGGAGATGAGTTGC TGGATGACGGGGAGGATGAGGAAGATGAAGACGAGGCCTGGAAGGCCTTCAACGGTGGCTGGACG GAGATGCCTGGGATCCTGTGGATGGAGCCTACGCAGCCGCCTGACTTTGCCCTGGCCTATAGACC GAGCTTCCCGAGGACAGAGAGCCACAGATACCCTACCCGGAGCCCACCTGGCCACCCCCGCTCA GTGCCCCAGGGTCCCCTACCACTCCTCAGTGCTCTCCGTCACCCGGCTGTGGTGGTCTCTGCC ACGCATCCCACACTGCCTTCTGCCCACCAGCCTCCTGTGATCCCTGCCACACACCCAGCTTTGTC CCGTGACCACCAGATCCCCGTGATCGCAGCCAACTATCCAGATCTGCCTTCTGCCTACCAACCCG GTATTCTCTCTGTCTCTCATTCAGCACAGCCTCCTGCCACCAGCCCCCTATGATCTCAACCAAA TATCCGGAGCTCTTCCCTGCCCACCAGTCCCCATGTTTCCAGACACCCGGGTCGCTGGCACCCA GACCACCACTCATTTGCCTGGAATCCCACCTAACCATGCCCTCTGGTCACCACCCTCGGTGCCC AGCTACCCCCTCAAGCCCAGATGCCCTTGTCCTCAGAACCCAGGCCACCCAGCTTCCCATTATC CCAACTGCCCAGCCCTCTCTGACCACCACCTCCAGGTCCCCTGTGTCTCCTGCCCATCAAATCTC TGTGCCTGCTGCCACCCAGCCCGCAGCCCTCCCCACCCTCCTGCCCTCTCAGAGCCCCACTAACC AGACCTCACCCATCAGCCCTACACATCCCCATTCCAAAGCCCCCAAATCCCAAGGGAAGATGGC CCCAGTCCCAAGTTGGCCCTGTGGCTGCCCTCACCAGCTCCACAGCAGCCCCAACAGCCCTGGG GGAGGCTGGTCTTGCCGAGCACAGCCAGAGGGATGACCGGACCGGAGGTGGTGGATCCGTGCCCA GGGATTGTGGTTGTAAGCCTTGCATATGTACAGTCCCAGAAGTATCATCTGTCTTCATCTTCCCC CCAAAGCCCAAGGATGTGCTCACCATTACTCTGACTCCTAAGGTCACGTGTGTTGTGGTAGACAT CAGCAAGGATGATCCCGAGGTCCAGTTCAGCTGGTTTGTAGATGATGTGGAGGTGCACACAGCTC AGACGAAACCCGGGAGGAGCAGATCAACAGCACTTTCCGTTCAGTCAGTGAACTTCCCATCATG CACCAGGACTGGCTCAATGGCAAGGAGTTCAAATGCAGGGTCAACAGTGCAGCTTTCCCTGCCCC CATCGAGAAACCATCTCCAAACCAAAGGCAGACCGAAGGCTCCACAGGTGTACACCATTCCAC CTCCCAAGGAGCAGATGGCCAAGGATAAAGTCAGTCTGACCTGCATGATAACAAACTTCTTCCCT GAAGACATTACTGTGGAGTGGCAGTGGAATGGGCAGCCAGCGGAGAACTACAAGAACACTCAGCC CATCATGGACACAGATGGCTCTTACTTCGTCTACAGCAAGCTCAATGTGCAGAAGAGCAACTGGG AGGCAGGAAATACTTTCACCTGCTCTGTGTTACATGAGGGCCTGCACAACCACCATACTGAGAAG AGCCTCTCCCACTCTCCTGGTAAATCCGGGCATCATCACCATCATCATTGA |
| 411. | soluble fusion protein of h Endosilain and m IgG1 Fc | artificial | aa | MLLRLLLAWAAAGPTLGQDPWAAEPRAACGPSSCYALFPRRRTFLEAWRACRELGGDLATPRTPE EAQRVDSLVGAGPASRLLWIGLQRQARQCQLQRPLRGFTWTTGDQDTAFTNWAQPASGGPCPAQR CVALEASGEHRWLEGSCTLAVDGYLCQFGFEGACPALQDEAGQAGPAVYTTPFHLVSTEFEWLPF GSVAAVQCQAGRGASLLCVKQPEGGVGWSRAGPLCLGTGCSPDNGGCEHECVEEVDGHVSCRCTE GFRLAADGRSCEDPCAQAPCEQQCEPGGPQGYSCHCRLGFRPAEDDPHRCVDTDECQIAGVCQQM CVNYVGGFECYCSEGHELEADGISCSPAGAMGAQASQDLGDELLDDGEDEEDEDEAWKAFNGGWT EMPGILWMEPTQPPDFALAYRPSFPEDREPQIPYPEPTWPPPLSAPRVPYHSSVLSVTRPVVVSA THPTLPSAHQPPVIPATHPALSRDHQIPVIAANYPDLPSAYQPGILSVSHSAQPPAHQPPMISTK YPELFPAHQSPMFPDTRVAGTQTTTHLPGIPPNHAPLVTTLGAQLPPQAPDALVLRTQATQLPII PTAQPSLTTTSRSPVSPAHQISVPAATQPAALPTLLPSQSPTNQTSPISPTHPHSKAPQIPREDG PSPKLALWLPSPAPTAAPTALGEAGLAEHSQRDDRTGGGSVPRDCGCKPCICTVPEVSSVFIFP PKPKDVLTITLTPKVTCVVVDISKDDPEVQFSWFVDDVEVHTAQTKPREEQINSTFRSVSELPIM HQDWLNGKEFKCRVNSAAFPAPIEKTISKTKGRPKAPQVYTIPPPKEQMAKDKVSLTCMITNFFP EDITVEWQWNGQPAENYKNTQPIMDTDGSYFVYSKLNVQKSNWEAGNTFTCSVLHEGLHNHHTEK SLSHSPGKSGHHHHHH |
| 412. | murine Endosilain construct | artificial | nt | ATGGGATGGAGCTGTATCATCCTCTTCTTGGTAGCAACAGCTACAGGTGTACACTCCGACTACAA AGATGATGACGATAAGTGGACGCCGGAGCCTCGAGCGCGTGCGGCCCCAGCAGCTGCTACGCGC TCTTTCCCGGCGCCGCACATTCCTGGAAGCTTGGCGGGCGTGCCGCGAATTGGGGGGCAACCTG GCCACACCGCGGACCCCAGAGGAGGCCCAGCGTGTGGACAGCCTGGTGGGGTCGGGCGGCCAA CGGGCTGCTATGGATTGGGTTGCAGCGGCAGGCTAGCAATGCCAGCCGCAGCGCCCACTGCGGG GCTTCATATGGACCACGGGAGACCAGGACACCGCCTTCACCAACTGGGCCCAGCCGGCTACGGAA GGACCCTGCCCAGCCCAGCGCTGTGCAGCCCTTGAGGCAGCGGAGAGCATCGCTGGCTCGAAGG CTCGTGCACACTGGCTGTCGATGGCTACCTCTGCCAGTTTGGTTTTGAGGGTGCCTGCCCTGCCT |

-continued

| SEQ ID NO. | DESIGNATION | SOURCE | TYPE | SEQUENCE |
|---|---|---|---|---|
| | | | | TGCCGCTTGAGGTGGGTCAGGCCGGTCCCGCTGTCTACACCACACCCTTCAACCTGGTTTCCAGC<br>GAGTTCGAATGGCTGCCCTTTGGCTCCGTGGCAGCTGTGCAGTGCCAAGCTGGCAGGGGAGCTTC<br>TCTGCTGTGCGTGAAACAGCCTTCAGGTGGCGTGGGCTGGTCCCAGACTGGCCCGCTGTGCCCAG<br>GGACTGGCTGTGGTCCTGACAATGGGGGTTGCGAACATGAGTGTGTGGAAGAGGTGGACGGTGCT<br>GTGTCCTGCCGCTGCAGTGAAGGCTTCCGTCTAGCAGCAGATGGGCACAGTTGTGAAGACCCCTG<br>TGCCCAGGCCCCCTGTGAGCAGCAGTGTGAACCTGGAGGGCCACAAGGCTATAGCTGCCACTGTC<br>GCCTTGGCTTCCGGCCAGCTGAGGATGATCCACACCGCTGCGTGGACACGGATGAGTGCCAGATT<br>GCTGGTGTGTGCCAGCAGATGTGTGTCAACTATGTTGGTGGCTTTGAGTGTTACTGCAGCGAGGG<br>TCACGAGCTTGAGGCAGATGGTATCAGCTGTAGCCCTGCAGGAGCCATGGGTGCCCAGGCTTCCC<br>AGGATCTCAGAGATGAGTTGCTGGATGATGGAGAAGAAGGGGAGGATGAAGAGGAGCCCTGGGAG<br>GACTTTGATGGCACCTGGACAGAGGAACAGGGGATCCTATGGCTGGCACCTACACATCCACCTGA<br>CTTTGGCCTGCCCTATAGGCCCAACTTCCCACAGGATGGAGAGCCTCAGAGATTGCACCTGGAGC<br>CTACCTGGCCACCCCCACTTAGTGCCCCCAGGGGCCCCTACCACTCCTCAGTGGTGTCTGCCACA<br>CGGCCCATGGTGATCTCTGCCACTCGACCCACACTACCTTCTGCCCACAAGACCTCTGTTATTTC<br>AGCTACACGCCCACCCCTGAGCCCTGTCCACCCACCTGCCATGGCCCCTGCCACACCTCCAGCTG<br>TGTTCTCTGAGCACCAGATCCCCAAAATCAAGGCCAATTATCCAGACCTGCCTTTTGGCCACAAG<br>CCTGGGATAACCTCGGCCACTCACCCAGCACGGTCTCCTCCGTACCAGCCCCCCATTATCTCAAC<br>CAACTATCCCCAAGTCTTCCCTCCCCACCAGGCCCCTATGTCTCCAGATACCCACACTATCACTT<br>ATTTGCCTCCAGTCCCCCCTCACCTTGATCCTGGGGATACCACTTCTAAAGCCCATCAACACCCT<br>TTGCTCCCAGATGCTCCAGGTATCAGAACCCAGGCCCCCCAGCTTTCTGTCTCAGCTCTCCAGCC<br>CCCTCTTCCTACCAACTCCAGGTCTTCTGTCCATGAAACTCCTGTGCCTGCTGCCAACCAGCCCC<br>CAGCCTTCCCTTCTTCTCCCCTCCCCCCTCAGAGGCCCACTAACCAGACCTCATCTATCAGCCCT<br>ACACATTCCTATTCCAGAGCCCCTCTAGTCCCAAGGGAAGGAGTTCCCAGTCCCAAATCAGTGCC<br>ACAGCTGCCCTCGGTGCCCTCCACAGCAGCTCCAACAGCCCTGGCAGAGTCAGGTCTTGCAGGCC<br>AAAGCCAAAGGGATGACCGCTGGCTGCTGGTGGCACTCCTGGTGCCAACATGTGTCTTCTTGGTG<br>GTGCTGCTTGCCCTGGGCATTGTGTACTGCACTCGCTGTGGCTCCCACGCACCCAACAAGCGGAT<br>CACGGACTGCTATCGCTGGGTCACACATGCTGGGAACAAGAGCTCAACAGAACCCATGCCCCCCA<br>GAGGCAGCCTTACAGGGGTACAGACCTGTAGAACCAGTGTGTGA |
| 413. | murine Endosilain construct | artificial | aa | MGWSCIILFLVATATGVHSDYKDDDDKWTPEPRAACGPSSCYALFPRRRTFLEAWRACRELGGNL<br>ATPRTPEEAQRVDSLVGVGPANGLLWIGLQRQARQCQPQRPLRGFIWTTGDQDTAFTNWAQPATE<br>GPCPAQRCAALEASGEHRWLEGSCTLAVDGYLCQFGFEGACPALPLEVGQAGPAVYTTPFNLVSS<br>EFEWLPFGSVAAVQCQAGRGASLLCVKQPSGGVGWSQTGPLCPGTGCGPDNGGCEHECVEEVDGA<br>VSCRCSEGFRLAADGHSCEDPCAQAPCEQQCEPGGPQGYSCHCRLGFRPAEDDPHRCVDTDECQI<br>AGVCQQMCVNYVGGFECYCSEGHELEADGISCSPAGAMGAQASQDLRDELLDDGEEGEDEEEPWE<br>DFDGTWTEEQGILWLAPTHPPDFGLPYRPNFPQDGEPQRLHLEPTWPPPLSAPRGPYHSSVVSAT<br>RPMVISATRPTLPSAHKTSVISATRPPLSPVHPPAMAPATPPAVFSEHQIPKIKANYPDLPFGHK<br>PGITSATHPARSPPYQPPIISTNYPQVFPPHQAPMSPDTHTITYLPPVPPHLDPGDTTSKAHQHP<br>LLPDAPGIRTQAPQLSVSALQPPLPTNSRSSVHETPVPAANQPPAFPSSPLPPQRPTNQTSSISP<br>THSYSRAPLVPREGVPSPKSVPQLPSVPSTAAPTALAESGLAGQSQRDDRWLLVALLVPTCVFLV<br>VLLALGIVYCTRCGSHAPNKRITDCYRWVTHAGNKSSTEPMPPRGSLTGVQTCRTSV |
| 414. | mutated human Endosilain antigen | artificial | nt | ATGGGATGGAGCTGTATCATCCTCTTCTTGGTAGCAACAGCTACAGGTGTACACTCCGACTACAA<br>AGATGATGACGATAAGTGGACGCCGGAGCCTCGAGCCGCGTGCGGCCCCAGCAGCTGCTACGCGC<br>TCTTTCCCCGGCGCCGCACATTCCTGGAAGCTTGGCGGGCGTGCCGCGAATTGGGGGGCAACCTG<br>GCCACACCGCGGACCCCAGAGGAGGCCCAGCGTGTGGACAGCCTGGTGGGGGTCGGGCCGGCCAA<br>CGGGCTGCTATGGATTGGGTTGCAGCGGCAGGCTAGGCAATGCCAGCCGCAGCGCCCACTGCGGG<br>GCTTCATATGGACCACGGGAGACCAGGACACCGCCTTCACCAACTGGGCCCAGCCGGCTACGGAA<br>GGACCCTGCCCAGCCCAGCGCTGTGCAGCCCTTGAGGCCAGCGGAGAGCATCGCTGGCTCGAAGG<br>CTCGTGCACACTGGCTGTCGATGGCTACCTCTGCCAGTTTGGTTTTGAGGGTGCCTGCCCTGCCT<br>TGCCGCTTGAGGTGGGTCAGGCCGGTCCAGCCGTGTATACCACGCCCTTCCACCTGGTCTCCACA<br>GAGTTTGAGTGGCTGCCCTTCGGCTCTGTGGCCGCTGTGCAGTGCCAGGCTGGCAGGGGAGCCTC<br>TCTGCTCTGCGTGAAGCAGCCTGAGGGAGGTGTGGGCTGGTCACGGGCTGGGCCCCTGTGCCTGG<br>GGACTGGCTGCAGCCCTGACAACGGGGGCTGCGAACACGAATGTGTGGAGGAGGTGGATGGTCAC<br>GTGTCCTGCCGCTGCACTGAGGGCTTCCGGCTGGCAGCAGACGGGCGCAGTTGCGAGGACCCCTG<br>TGCCCAGGCTCCGTGCGAGCAGCAGTGTGAGCCCGGTGGGCCACAAGGCTACAGCTGCCACTGTC<br>GCCTGGGTTTCCGGCCAGCGGAGGATGATCCGCACCGCTGTGTGGACACAGATGAGTGCCAGATT<br>GCCGGTGTGTGCCAGCAGATGTGTGTCAACTACGTTGGTGGCTTCGAGTGTTATTGTAGCGAGGG<br>ACATGAGCTGGAGGCTGATGGCATCAGCTGCAGCCCTGCAGGGGCCATGGGTGCCCAGGCTTCCC<br>AGGACCTCGGAGATGAGTTGCTGGATGACGGGGAGGATGAGGAAGATGAAGACGAGGCCTGGAAG<br>GCCTTCAACGGTGGCTGGACGGAGATGCCTGGGATCCTGTGGATGGAGCCTACGCAGCCGCCTGA<br>CTTTGCCCTGGCCTATAGACCGAGCTTCCCAGAGGACAGAGAGCCACAGATACCCTACCCGGAGC<br>CCACCTGGCCACCCCCGCTCAGTGCCCCCAGGGTCCCCTACCACTCCTCAGTGCTCTCCGTCACC<br>CGGCCTGTGGTGGTCTCTGCCACGCATCCCACACTGCCTTCTGCCCACCAGCCTCCTGTGATCCC<br>TGCCACACACCCAGCTTTGTCCCGTGACCACCAGATCCCCGTGATCGCAGCCAACTATCCAGATC<br>TGCCTTCTGCCTACCAACCCGGTATTCTCTCTGTCTCTCATTCAGCACAGCCTCCTGCCCACCAG<br>CCCCCTATGATCTCAACCAAATATCCGGAGCTCTTCCCTGCCCACCAGTCCCCCATGTTTCCAGA<br>CACCCGGGTCGCTGGCACCCAGACCACCACTCATTTGCCTGGAATCCCACCTAACCATGCCCCTC<br>TGGTCACCACCCTCGGTGCCCAGCTACCCCCTCAAGCCCCAGATGCCCTTGTCCTCAGAACCCAG<br>GCCACCCAGCTTCCCATTATCCCAACTGCCCAGCCCTCTCTGACCACCACCTCCAGGTCCCCTGT<br>GTCTCCTGCCCATCAAATCTCTGTGCCTGCTGCCACCCAGCCCGCAGCCCTCCCCACCCTCCTGC<br>CCTCTCAGAGCCCCACTAACCAGACCTCACCCATCAGCCCTACACATCCCCATTCCAAAGCCCCC<br>CAAATCCCAAGGGAAGATGGCCCCAGTCCCAAGTTGGCCCTGTGGCTGCCCTCACCAGCTCCCAC<br>AGCAGCCCCAACAGCCCTGGGGGAGGCTGGTCTTGCCGAGCACAGCCAGAGGGATGACCGGTGGC<br>TGCTGGTGGCACTCCTGGTGCCAACGTGTGTCTTTTTGGTGGTCCTGCTTGCACTGGGCATCGTG |

| SEQ ID NO. | DESIGNATION | SOURCE | TYPE | SEQUENCE |
|---|---|---|---|---|
| | | | | TACTGCACCCGCTGTGGCCCCCATGCACCCAACAAGCGCATCACTGACTGCTATCGCTGGGTCAT CCATGCTGGGAGCAAGAGCCCAACAGAACCCATGCCCCCAGGGGCAGCCTCACAGGGGTGCAGA CCTGCAGAACCAGCGTGTGA |
| 415. | mutated human Endosilain antigen | artificial | aa | MGWSCIILFLVATATGVHSDYKDDDDKWTPEPRAACGPSSCYALFPRRRTFLEAWRACRELGGNL ATPRTPEEAQRVDSLVGVGPANGLLWIGLQRQARQCQPQRPLRGFIWTTGDQDTAFTNWAQPATE GPCPAQRCAALEASGEHRWLEGSCTLAVDGYLCQFGFEGACPALPLEVGQAGPAVYTTPFHLVST EFEWLPFGSVAAVQCQAGRGASLLCVKQPEGGVGWSRAGPLCLGTGCSPDNGGCEHECVEEVDGH VSCRCTEGFRLAADGRSCEDPCAQAPCEQQCEPGGPQGYSCHCRLGFRPAEDDPHRCVDTDECQI AGVCQQMCVNYVGGFECYCSEGHELEADGISCSPAGAMGAQASQDLGDELLDDGEDEEDEDEAWK AFNGGWTEMPGILWMEPTQPPDFALAYRPSFPEDREPQIPYPEPTWPPPLSAPRVPYHSSVLSVT RPVVVSATHPTLPSAHQPPVIPATHPALSRDHQIPVIAANYPDLPSAYQPGILSVSHSAQPPAHQ PPMISTKYPELFPAHQSPMFPDTRVAGTQTTTHLPGIPPNHAPLVTTLGAQLPPQAPDALVLRTQ ATQLPIIPTAQPSLTTTSRSPVSPAHQISVPAATQPAALPTLLPSQSPTNQTSPISPTHPHSKAP QIPREDGPSPKLALWLPSPAPTAAPTALGEAGLAEHSQRDDRWLLVALLVPTCVFLVVLLALGIV YCTRCGPHAPNKRITDCYRWVIHAGSKSPTEMPPRGSLTGVQTCRTSV |
| 416. | mutated murine Endosilain antigen | artificial | nt | ATGGGAT

| SEQ ID NO. | DESIGNATION | SOURCE | TYPE | SEQUENCE |
|---|---|---|---|---|
| 420. | macaque Endosilain forward primer | artificial | nt | GTCAACTACGTTGGTGGCTTCGAGTG |
| 421. | macaque Endosilain reverse primer | artificial | nt | GGTCTAGATCACTTATCGTCATCATCTTTGTAGTCCACGCTGGTTCTGCAGGTCTGC |
| 422. | macaque Endosilain | artificial | nt | ATGCTGCTGCGCCTGTTGCTGGCCTGGGCGGCCGCAGGGCCCACACTGGGCCAGGACCCCTGGGC TGCTGAGCCCCGCTCCGCCTGCGGCCCCAGCAGCTGCTACGCTCTCTTTCCACGGCGCCGCACCT TTCTGGAGGCCTGGCGGGCCTGCCGCGAGCTGGGGGGCGACCTGGCCACTCCTCGGACCCCCGAG GAGGCCCAGCGTGTGGACAACCTGGTGGGTGCAGGCCCGGCCAGCCGGCTGCTGTGGATCGGCCT GCAGCGGCAGGCCCGGCAATGCCAGCTGCAGCGCCCACTGCGAGGGCTTCACGTGGACCACAGGGG ACCAGGACACGGCTTTCACCAACTGGGCCCAGCCAGCCACTGGAGGCCCCTGCCCGGCCCAGCGC TGTGTGGCCCTGGAGGCGAGTGGCGAGCACCGCTGGCTGGAGGGCTCATGCACGCTGGCTGTCGA CGGCTACTTGTGCCAGTTTGGCTTCGAGGGTGCCTGCCCAGCGCTGCAAGACGAAGCGGGCCAGG CCGGCCCAGCCGTCTATACCACGCCCTTCCACCTGGTCTCCACAGAGTTTGAGTGGCTACCCTTC GGCTCTGTGGCCGCTGTGCAGTGCCAGGCTGGCAGGGGAGCCTCTCTGCTCTGCGTGAAGCAGCC CGAGGGAGGTGTGGGCTGGTCACGGGCAGGGCCCCTGTGCCTGGGGGCTGGCTGCAGCCCTGACA ACGGGGGCTGCGAACACGAATGTGTGGAGGAGGTGGATGGTCACGTGTCCTGCCGCTGCACTGAG GGCTTCCGGCTGGCAGCAGACGGGCGCAGTTGCGAGGATCCCTGTGCCCAGGCTCCATGCGAGCA GCAGTGTGAGCCCGGTGGGCCACAAGGCTACGACTGCCACTGTCGCCTGGGCTTCCGACCTGCAG AGGATGATCCGCACCGCTGTGTGGACACAGATGAGTGCCAGATTGCCGGTGTGTGCCAGCAGATG TGTGTCAACTACGTTGGTGGCTTCGAGTGTTATTGTAGTGAGGGTCATGAGCTGGAGGCTGATGG CATCAGCTGCAGCCCTGCAGGGGCATGGGTGCCCGGGCTTCCCAGGACCTCGGAGATGAGTTGC TGGATGATGGGGAGGATGAGGAAGATGAAGACGAGGCCTGGGAGGCCTTTGGCGGTGGCTGGACG GAGATGCCTGGGATCCTGTGGATGGAGCCTACTCAGCCGCTGACTTTGCCCTGGCCTATAGACC GAGCTTCCCAGAGGACAGAGAGCCACAGATACCCTACCGGAGCCCACCTGGCCGCCCCGCTCA GTGCCCCCAGGGTCCCCTACCACTCCTCAGTGCTCTCCGTCACCCGGCCTGTGGTGGTCTCTGCC ACGCGCCCCACACTGCCTTCCGCCCACCAGCCTCCTGTGATCCCTGCCACCACACCCAGCTTTGTC CCGTGACCACCAGATCCCCGTGATCGCAGCCAACTATCCAGATCTGCCTTCTGCCTACCAACCCG GTATTCTCTCTGTCTCTCATCCAGCACAGCCCCTGCCCACCAGCCCCCATGATCTCAACCAGA TATCCTGAGCTGTTCCCTGCCCACCAGTCCCCATGTTTCCAGACACCCAGGTCGCTGGCACCCA GACCACCACTCATTTGCCTGCAATCCCACCTAACCGTGCCCCTCTGGTCACCACACTCGGTGCCC ATCAACCCCCTCAAGCCCAGATGCCCCTGTCCTCAGAACCCAGGCTACCCAGCTTCCCATTATC CCTACTGCCCAGCCGTCTCTGACCACCAGCTCCAGGTCCCCTGTGTCTCCTGCCCATCAAGTCTC TGTGCCTGCTGCCACCCAGCCCCAGCCCTCCCACCCTCCTGCCCTCTCAGAGCCCCACTAACC AGACCTCACCCATCAGCCCTACACATCCCCATTCCAAAGTCCCCCAAATCCCAAGGGAAGATGGC CCCAGTCCAAGCTGGCCCTGTGGCCTGCCCTCAGCAGCTCCCACAGCAGCCCCAACAGCCCTGGG GGAGGCTAGTCTTGCCGAGCACATCCAGAGGGATGACCGGTGGCTTCTGGTGGCACTCCTCGTGC CAACGTGTGTCTTTTTGGTGGTCCTGCTTGCACTGGGCATTGTGTACTGCACCCGCTGTGGCCCC CATGCACCCAACAAGCGCATCACTGACTGCTATCGCTGGGTCACCCATGCTGGGAGCAAGAGTCC AACAGAACCCATGCCCCCAGGGGCAGCCTCACAGGGGTGCAGACCTGCAGAACCAGCGTGGACT ACAAAGATGATGACGATAAGTGA |
| 423. | macaque Endosilain | artificial | aa | MLLRLLLAWAAAGPTLGQDPWAAEPRSACGPSSCYALFPRRRTFLEAWRACRELGGDLATPRTPE EAQRVDNLVGAGPASRLLWIGLQRQARQCQLQRPLRGFTWTTGDQDTAFTNWAQPATGGPCPAQR CVALEASGEHRWLEGSCTLAVDGYLCQFGFEGACPALQDEAGQAGPAVYTTPFHLVSTEFEWLPF GSVAAVQCQAGRGASLLCVKQPEGGVGWSRAGPLCLGAGCSPDNGGCEHECVEEVDGHVSCRCTE GFRLAADGRSCEDPCAQAPCEQQCEPGGPQGYSCHCRLGFRPAEDDPHRCVDTDECQIAGVCQQM CVNYVGGFECYCSEGHELEADGISCSPAGAMGARASQDLGDLELLDDGEDEEDEDEAWEAFGGGWT EMPGILWMEPTQPPDFALAYRPSFPEDREPQIPYPEPTWPPPLSAPRVPYHSSVLSVTRPVVVSA TRPTLPSAHQPPVIPATHPALSRDHQIPVIAANYPDLPSAYQPGILSVSHPAQPPAHQPPMISTR YPELFPAHQSPMFPDTQVAGTQTTTHLPAIPPNRAPLVTTLGAHQPPQAPDAPVLRTQATQLPII PTAQPSLTTSSRSPVSPAHQVSVPAATQPPALPTLLPSQSPTNQTSPISPTHPHSKVPQIPREDG PSPKLALWLPSAAPTAAPTALGEASLAEHIQRDDRWLLVALLVPTCVFLVVLLALGIVYCTRCGP HAPNKRITDCYRWVTHAGSKSPTEPMPPRGSLTGVQTCRTSVDYKDDDDK |
| 424. | human IGF-R1 construct | artificial | nt | ATGAAGTCTGGCTCCGGCGGAGGGTCCCGACCTCGCTGTGGGGGCTCCTGTTTCTCTCCGCCGC GCTCTCGCTCTGGCCGACGAGTGGAGAAATCTGCGGGCCAGGCATCGACATCCGCAACGACTATC AGCAGCTGAAGCGCCTGGAGAACTGCACGGTGATCGAGGGCTACCTCCACATCCTGCTCATCTCC AAGGCCGAGGACTACCGCAGCTACCGCTTCCCCAAGCTCACGGTCATTACCGAGTACTTGCTGCT GTTCCGAGTGGCTGGCCTCGAGAGCCTCGGAGACCTCTTCCCCAACCTCACGGTCATCCGCGGCT GGAAACTCTTCTACAACTACGCCCTGGTCATCTTCGAGATGACCAATCTCAAGGATATTGGGCTT TACAACCTGAGGAACATTACTCGGGGGGCCATCAGGATTGAGAAAAATGCTGACCTCTGTTACCT CTCCACTGTGGACTGGTCCCTGATCCTGGATGCGGTGTCCAATAACTACATTGTGGGGAATAAGC CCCCAAAGGAATGTGGGGACCTGTGTCCAGGGACCATGGAGGAGAAGCCGATGTGTGAAGAGACC ACCATCAACAATGAGTACAACTACCGCTGCTGGACCACAAACCGCTGCCAGAAAATGTGCCCAAG CACGTGTGGGAAGCGGGCGTGCACCGAGAACAATGAGTGCTGCCACCCCGAGTGCCTGGGCAGCT GCAGCGCGCCTGACAACGACACGGCCTGTGTAGCTTGCCGCCACTACTACTATGCCGGTGTCTGT GTGCCTGCCTGCCCGCCCAACACCTACAGGTTTGAGGGCTGGCGCTGTGTGGACCGTGACTTCTG CGCCAACATCCTCAGCGCCGAGAGCAGCGACTCCGAGGGGTTTGTGATCCACGACGGCGAGTGCA TGCAGGAGTGCCCCTCGGGCTTCATCCGCAACGGCAGCCAGAGCATGTACTGCATCCCTTGTGAA GGTCCTTGCCCGAAGGTCTGTGAGGAAGAAAAGAAAACAAAGACCATTGATTCTGTTACTTCTGC TCAGATGCTCCAAGGATGCACCATCTTCAAGGGCAATTTGCTCATTAACATCCGACGGGGGAATA |

| SEQ ID NO. | DESIGNATION | SOURCE | TYPE | SEQUENCE |
|---|---|---|---|---|
| | | | | ACATTGCTTCAGAGCTGGAGAACTTCATGGGGCTCATCGAGGTGGTGACGGGCTACGTGAAGATC<br>CGCCATTCTCATGCCTTGGTCTCCTTGTCCTTCCTAAAAAACCTTCGCCTCATCCTAGGAGAGGA<br>GCAGCTAGAAGGGAATTACTCCTTCTACGTCCTCGACAACCAGAACTTGCAGCAACTGTGGGACT<br>GGGACCACCGCAACCTGACCATCAAAGCAGGGAAAATGTACTTTGCTTTCAATCCCAAATTATGT<br>GTTTCCGAAATTTACCGCATGGAGGAAGTGACGGGGACTAAAGGGCGCCAAAGCAAAGGGGACAT<br>AAACACCAGGAACAACGGGGAGAGAGCCTCCTGTGAAAGTGACGTCCTGCATTTCACCTCCACCA<br>CCACGTCGAAGAATCGCATCATCATAACCTGGCACCGGTACCGGCCCCTGACTACAGGGATCTC<br>ATCAGCTTCACCGTTTACTACAAGGAAGCACCCTTTAAGAATGTCACAGAGTATGATGGGCAGGA<br>TGCCTGCGGCTCCAACAGCTGGAACATGGTGGACGTGGACCTCCCGCCCAACAAGGACGTGGAGC<br>CCGGCATCTTACTACATGGGCTGAAGCCCTGGACTCAGTACGCCGTTTACGTCAAGGCTGTGACC<br>CTCACCATGGTGGAGAACGACCATATCCGTGGGGCCAAGAGTGAGATCTTGTACATTCGCACCAA<br>TGCTTCAGTTCCTTCCATTCCCTTGGACGTTCTTTCAGCATCGAACTCCTCTTCTCAGTTAATCG<br>TGAAGTGGAACCCTCCCTCTCTGCCCAACGGCAACCTGAGTTACTACATTGTGCGCTGGCAGCGG<br>CAGCCTCAGGACGGCTACCTTTACCGGCACAATTACTGCTCCAAAGACAAAATCCCCATCAGGAA<br>GTATGCCGACGGCACCATCGACATTGAGGAGGTCACAGAGAACCCCAAGACTGAGGTGTGTGGTG<br>GGGAGAAAGGGCCTTGCTGCGCCTGCCCCAAACTGAAGCCGAGAAGCAGGCCGAGAAGGAGGAG<br>GCTGAATACCGCAAAGTCTTTGAGAATTTCCTGCACAACTCCATCTTCGTCCCCAGACCTGAAAG<br>GAAGCGGAGAGATGTCATGCAAGTGGCCAACACCACCATGTCCAGCCGAAGCAGGAACACCACGG<br>CCGCAGACACCTACAACATCACCGACCCGGAAGAGCTGGAGACAGAGTACCCTTTCTTTGAGAGC<br>AGAGTGGATAACAAGGAGAGAACTGTCATTTCTAACCTTCGGCCTTTCACATTGTACCGCATCGA<br>TATCCACAGCTGCAACCACGAGGCTGAGAAGCTGGGCTGCAGCGCCTCCAACTTCGTCTTTGCAA<br>GGACTATGCCCGCAGAAGGAGCAGATGACATTCCTGGGCCAGTGACCTGGGAGCCAAGGCCTGAA<br>AACTCCATCTTTTTAAAGTGGCCGGAACCTGAGAATCCCAATGGATTGATTCTAATGTATGAAAT<br>AAAAATACGGATCACAAGTTGAGGATCAGCGAGAATGTGTGTCCAGACAGGAATACAGGAAGTATG<br>GAGGGGCCAAGCTAAACCGGCTAAACCCGGGGAACTACACAGCCCGGATTCAGGCCACATCTCTC<br>TCTGGGAATGGGTCGTGGACAGATCCTGTGTTCTTCTATGTCCAGGCCAAAACAGGATATGAAAA<br>CTTCATCCATCTGATCATCGCTCTGCCCGTCGCTGTCCTGTTGATCGTGGGAGGGTTGGTGATTA<br>TGCTGTACGTCTTCCATAGAAAGAGAAATAACAGCAGGCTGGGGAATGGAGTGCTGTATGCCTCT<br>GTGAACCCGGAGTACTTCAGCGCTGCTGATGTGTACGTTCCTGATGAGTGGGAGGTGGCTCGGGA<br>GAAGATCACCATGAGCCGGGAACTTGGCCAGGGGTCGTTTGGGATGGTCTATGAAGGAGTTGCCA<br>AGGGTGTGGTGAAAGATGAACCTGAAACCAGAGTGGCCATTAAAACAGTGAACGAGGCCGCAAGC<br>ATGCGTGAGAGGATTGAGTTTCTCAACGAAGCTTCTGTGATGAAGGAGTTCAATTGTCACCATGT<br>GGTGCGATTGCTGGGTGTGGTGTCCCAAGGCCAGCCAACACTGGTCATCATGGAACTGATGACAC<br>GGGGCGATCTCAAAAGTTATCTCCGGTCTCTGAGGCCAGAAATGGAGAATAATCCAGTCCTAGCA<br>CCTCCAAGCCTGAGCAAGATGATTCAGATGGCCGGAGAGATTGCAGACGGCATGGCATACCTCAA<br>CGCCAATAAGTTCGTCCAGAGAGACCTTGCTGCCCGGAATTGCATGGTAGCCGAAGATTTCACAG<br>TCAAAATCGGAGATTTTGGTATGACGCGAGATATCTATGAGACAGACTATTACCGGAAAGGAGGG<br>AAAGGGCTGCTGCCCGTGCGCTGGATGTCTCCTGAGTCCCTCAAGGATGAGTCTTCACCACTTA<br>CTCGGACGTCTGGTCCTTCGGGGTTGTCCTCTGGGAGATCGCCACACTGGCCGAGCAGCCCTACC<br>AGGGCTTGTCCAACGAGCAAGTCCTTCGCTTCGTCATGGAGGGCGGCCTTCTGGACAAGCCAGAC<br>AACTGTCCTGACATGCTGTTTGAACTGATGCGCATGTGCTGGCAGTATAACCCCAAGATGAGGCC<br>TTCCTTCCTGGAGATCATCAGCAGCATCAAAGAGGAGATGGAGCCTGGCTTCCGGGAGGTCTCCT<br>TCTACTACAGCGAGGAGAACAAGCTGCCCGAGCCGGAGGAGCTGGACCTGGAGCCAGAGAACATG<br>GAGAGCGTCCCCCTGGACCCCTCGGCCTCCTCGTCCTCCCTGCCACTGCCCGACAGACACTCAGG<br>ACACAAGGCCGAGAACGGCCCCGGCCCTGGGGTGCTGGTCCTCCGCGCCAGCTTCGACGAGAGAC<br>AGCCTTACGCCCACATGAACGGGGGCCGCAAGAACGAGCGGGCCTTGCCGCTGCCCCAGTCTTCG<br>ACCTGCTGA |
| 425. | human IGF-R1 construct | artificial | aa | MKSGSGGGSPTSLWGLLFLSAALSLWPTSGEICGPGIDIRNDYQQLKRLENCTVIEGYLHILLIS<br>KAEDYRSYRFPKLTVITEYLLLFRVAGLESLGDLFPNLTVIRGWKLFYNYALVIFEMTNLKDIGL<br>YNLRNITRGAIRIEKNADLCYLSTVDWSLILDAVSNNYIVGNKPPKECGDLCPGTMEEKPMCEKT<br>TINNEYNYRCWTTNRCQKMCPSTCGKRACTENNECCHPECLGSCSAPDNDTACVACRHYYAGVC<br>VPACPPNTYRFEGWRCVDRDFCANILSAESSDSEGFVIHDGECMQECPSGFIRNGSQSMYCIPCE<br>GPCPKVCEEEKKTKTIDSVTSAQMLQGCTIFKGNLLINIRRGNNIASELENFMGLIEVVTGYVKI<br>RHSHALVSLSFLKNLRLILGEEQLEGNYSFYVLDNQNLQQLWDWDHRNLTIKAGKMYFAFNPKLC<br>VSEIYRMEEVTGTKGRQSKGDINTRNNGERASCESDVLHFTSTTTSKNRIIITWHRYRPPDYRDL<br>ISFTVYYKEAPFKNVTEYDGQDACGSNSWNMVDVDLPPNKDVEPGILLHGLKPWTQYAVYVKAVT<br>LTMVENDHIRGAKSEILYIRTNASVPSIPLDVLSASNSSSQLIVKWNPPSLPNGNLSYYIVRWQR<br>QPQDGYLYRHNYCSKDKIPIRKYADGTIDIEEVTENPKTEVCGGEKGPCCACPKTEAEKQAEKEE<br>AEYRKVFENFLHNSIFVPRPERKRRDVMQVANTTMSSRSRNTTAADTYNITDPEELETEYPFFES<br>RVDNKERTVISNLRPFTLYRIDIHSCNHEAEKLGCSASNFVFARTMPAEGADDIPGPVTWEPRPE<br>NSIFLKWPEPENPNGLILMYEIKYGSQVEDQRECVSRQEYRKYGGAKLNRLNPGNYTARIQATSL<br>SGNGSWTDPVFFYVQAKTGYENFIHLIIALPVAVLLIVGGLVIMLYVFHRKRNNSRLGNGVLYAS<br>VNPEYFSAADVYVPDEWEVAREKITMSRELGQGSFGMVYEGVAKGVVKDEPETRVAIKTVNEAAS<br>MRERIEFLNEASVMKEFNCHHVVRLLGVVSQGQPTLVIMELMTRGDLKSYLRSLRPEMENNPVLA<br>PPSLSKMIQMAGEIADGMAYLNANKFVHRDLAARNCMVAEDFTVKIGDFGMTRDIYETDYYRKGG<br>KGLLPVRWMSPESLKDGVFTTYSDVWSFGVVLWEIATLAEQPYQGLSNEQVLRFVMEGGLLDKPD<br>NCPDMLFELMRMCWQYNPKMRPSFLEIISSIKEEMEPGFREVSFYYSEENKLPEPEELDLEPENM<br>ESVPLDPSASSSSLPLPDRHSGHKAENGPGPGVLVLRASFDERQPYAHMNGGRKNERALPLPQSS<br>TC |
| 426. | soluble fusion protein of h IGF-R1 and m IgG1 Fc | artificial | nt | ATGAAGTCTGGCTCCGGCGGAGGGTCCCCGACCTCGCTGTGGGGGCTCCTGTTTCTCTCCGCCGC<br>GCTCTCGCTCTGGCCGACGAGTGGAGAAATCTGCGGGCCAGGCATCGACATCCGCAACGACTATC<br>AGCAGCTGAAGCGCCTGGAGAACTGCACGGTGATCGAGGGCTACCTCCACATCCTGCTCATCTCC<br>AAGGCCGAGGACTACCGCAGCTACCGCTTCCCCAAGCTCACGGTCATTACCGAGTACTTGCTGCT |

| SEQ ID NO. | DESIGNATION | SOURCE | TYPE | SEQUENCE |
|---|---|---|---|---|
| | | | | GTTCCGAGTGGCTGGCCTCGAGAGCCTCGGAGACCTCTTCCCCAACCTCACGGTCATCCGCGCT<br>GGAAACTCTTCTACAACTACGCCCTGGTCATCTTCGAGATGACCAATCTCAAGGATATTGGGCTT<br>TACAACCTGAGGAACATTACTCGGGGGGCCATCAGGATTGAGAAAAATGCTGACCTCTGTTACCT<br>CTCCACTGTGGACTGGTCCCTGATCCTGGATGCGGTGTCCAATAACTACATTGTGGGGAATAAGC<br>CCCCAAAGGAATGTGGGGACCTGTGTCCAGGGACCCATGGAGGAGAAGCCGATGTGTGAGAAGACC<br>ACCATCAACAATGAGTACAACTACCGCTGCTGGACCACAAACCGCTGCCAGAAAATGTGCCCAAG<br>CACGTGTGGGAAGCGGGCGTGCACCGAGAACATGAGTGCTGCCACCCCGAGTGCCTGGGCAGCT<br>GCAGCGCGCCTGACAACGACACGGCCTGTGTAGCTTGCCGCCACTACTACTATGCCGGTGTCTGT<br>GTGCCTGCCTGCCCGGCCCAACACCTACAGGTTTGAGGGCTGGCGCTGTGTGGACCGTGACTTCTG<br>CGCCAACATCCTCAGCGCCGAGAGCAGCGACTCCGAGGGGTTTGTGATCCACGACGGCGAGTGCA<br>TGCAGGAGTGCCCCTCGGGCTTCATCCGAACGGCAGCCAGAGCATGTACTGCATCCCTTGTGAA<br>GGTCCTTGCCCGAAGGTCTGTGAGGAAGAAAAGAAAACAAAGACCATTGATTCTGTTACTTCTGC<br>TCAGATGCTCCAAGGATGCACCATCTTCAAGGGCAATTTGCTCATTAACATCCGACGGGGGAATA<br>ACATTGCTTCAGAGCTGGAGAACTTCATGGGGCTCATCGAGGTGGTGACGGGCTACGTGAAGATC<br>CGCCATTCTCATGCCTTGGTCTCCTTGTCCTTCCTAAAAAACCTTCGCCTCATCCTAGGAGAGGA<br>GCAGCTAGAAGGGAATTACTCCTTCTACGTCCTCGACAACCAGAACTTGCAGCAACTGTGGGACT<br>GGGACCACCGCAACCTGACCATCAAAGCAGGGAAAATGTACTTTGCTTTCAATCCCAAATTATGT<br>GTTTCCGAAATTTACCGCATGGAGGAAGTGACGGGGACTAAAGGGCGCCAAAGCAAAGGGGACAT<br>AAACACCAGGAACAACGGGGAGAGAGCCTCCTGTGAAAGTGACGTCCTGCATTTCACCTCCACCA<br>CCACGTCGAAGAATCGCATCATCATAACCTGGCACCGGTACCGGCCCCTGACTACAGGGATCTC<br>ATCCAGCTTCACCGTTTACTACAAGGAAGCACCCTTTAAGAATGTCACAGAGTATGATGGGCAGGA<br>TGCCTGCGGCTCCAACAGCTGGAACATGGTGGACGTGGACCTCCCGCCCAACAAGGACGTGGAGC<br>CCGGCATCTTACTACATGGGCTGAAGCCCTGGACTCAGTACGCCGTTTACGTCAAGGCTGTGACC<br>CTCACCATGGTGGAGAACGACCATATCCGTGGGGCCAAGAGTGAGATCTTGTACATTCGCACCAA<br>TGCTTCAGTTCCTTCCATTCCCTTGGACGTTCTTTCAGCATCGAACTCCTCTTCTCAGTTAATCG<br>TGAAGTGGAACCCTCCCTCTCTGCCCAACGGCAACCTGAGTTACTACATTGTGCGCTGGCAGCGG<br>CAGCCTCAGGACGGCTACCTTTACCGGCACAATTACTGCTCCAAAGACAAAATCCCCATCAGGAA<br>GTATGCCGACGGCACCATCGACATTGAGGAGGTCACAGAGAACCCCAAGACTGAGGTGTGTGGTG<br>GGGAGAAAGGGCCTTGCTGCGCCTGCCCCAAAACTGAAGCCGAGAAGCAGGCCGAGAAGGAGGAG<br>GCTGAATACCGCAAAGTCTTTGAGAATTTCCTGCACAACTCCATCTTCGTGCCCAGACCTGAAAG<br>GAAGCGGAGAGATGTCATGCAAGTGGCCAACACCACCATGTCCAGCCGAAGCAGGAACACCACGG<br>CCGCAGACACCTACAACATCACCGACCCGGAAGAGCTGGAGACAGAGTACCCTTTCTTTGAGAGC<br>AGAGTGGATAACAAGGAGAGAACTGTCATTTCTAACCTTCGGCCTTTCACATTGTACCGCATCGA<br>TATCCACAGCTGCAACCACGAGGCTGAGAAGCTGGGCTGCAGCGCCTCCAACTTCGTCTTTGCAA<br>GGACTATGCCCGCAGAAGGAGCAGATGACATTCCTGGGCCAGTGACCTGGGAGCCAAGGCCTGAA<br>ACTCCATCTTTTTAAAGTGGCCGGAACCTGAGAATCCCAATGGATTGATTCTAATGTATGAAAT<br>AAAATACGGATCACAAGTTGAGGATCAGCGAGAATGTGTGTCCAGACAGGAATACAGGAAGTATG<br>GAGGGGCCAAGCTAAACCGGCTAAACCCGGGGAACTACACAGCCCGGATTCAGGCCACATCTCTC<br>TCTGGGAATGGGTCGTGGACAGATCCTGTGTTCTTCTATGTCCAGGCCAAAACAGGATATGAAAA<br>CTTCATCCATTCCGGAGGTGGTGGATCCGTGCCCAGGGATTGTGGTTGTAAGCCTTGCATATGTA<br>CAGTCCCAGAAGTATCATCTGTCTTCATCTTCCCCCCAAAGCCCAAGGATGTGCTCACCATTACT<br>CTGACTCCTAAGGTCACGTGTGTTGTGGTAGACATCAGCAAGGATGATCCCGAGGTCCAGTTCAG<br>CTGGTTTGTAGATGATGTGGAGGTGCACACAGCTCAGACAGAACCCCGGGAGGAGCAGATCAACA<br>GCACTTTCCGTTCAGTCAGTGAACTTCCCATCATGCACCAGGACTGGCTCAATGGCAAGGAGTTC<br>AAATGCAGGGTCAACAGTGCAGCTTTCCCTGCCCCCATCGAGAAAACCATCTCCAAAACCAAGG<br>GCAGACCGAAGGCTCCACAGGTGTACACCATTCCACCTCCCAAGGAGCAGATGGCCAAGGATAAAG<br>TCAGTCTGACCTGCATGATAACAAACTTCTTCCCTGAAGACATTACTGTGGAGTGGCAGTGGAAT<br>GGGCAGCCAGCGGAGAACTACAAGAACACTCAGCCCATCATGGACACAGATGGCTCTTACTTCGT<br>CTACAGCAAGCTCAATGTGCAGAAGAGCAACTGGGAGGCAGGAAATACTTTACCTGCTCTGTGT<br>TACATGAGGGCCTGCACAACCACCATACTGAGAAGAGCCTCTCCCACTCTCCTGGTAAATCCGGG<br>CATCATCACCATCATCATTGA |
| 427. | soluble fusion protein of h IGF-R1 and m IgG1 Fc | artificial | aa | MKSGSGGGSPTSLWGLLFLSAALSLWPTSGEICGPGIDIRNDYQQLKRLENCTVIEGYLHILLIS<br>KAEDYRSYRFPKLTVITEYLLLFRVAGLESLGDLFPNLTVIRGWKLFYNYALVIFEMTNLKDIGL<br>YNLRNITRGAIRIEKNADLCYLSTVDWSLILDAVSNNYIVGNKPPKECGDLCPGTMEEKPMCEKT<br>TINNEYNYRCWTTNRCQKMCPSTCGKRACTENNECCHPECLGSCSAPDNDTACVACRHYYYAGVC<br>VPACPPNTYRFEGWRCVDRDFCANILSAESSDSEGFVIHDGECMQECPSGFIRNGSQSMYCIPCE<br>GPCPKVCEEEKKTKTIDSVTSAQMLQGCTIFKGNLLINIRRGNNIASELENFMGLIEVVTGYVKI<br>RHSHALVSLSFLKNLRLILGEEQLEGNYSFYVLDNQNLQQLWDWDHRNLTIKAGKMYFAFNPKLC<br>VSEIYRMEEVTGTKGRQSKGDINTRNNGERASCESDVLHFTSTTTSKNRIITWHRYRPPDYRDL<br>ISFTVYYKEAPFKNVTEYDGQDACGSNSWNMVDVDLPPNKDVEPGILLHGLKPWTQYAVYVKAVT<br>LTMVENDHIRGAKSEILYIRTNASVPSIPLDVLSASNSSSQLIVKWNPPSLPNGNLSYYIVRWQR<br>QPQDGYLYRHNYCSKDKIPIRKYADGTIDIEEVTENPKTEVCGGEKGPCCACPKTEAEKQAEKEE<br>AEYRKVFENFLHNSIFVPRPERKRRDVMQVANTTMSSRSRNTTAADTYNITDPEELETEYPFFES<br>RVDNKERTVISNLRPFTLYRIDIHSCNHEAEKLGCSASNFVFARTMPAEGADDIPGPVTWEPRPE<br>NSIFLKWPEPENPNGLILMYEIKYGSQVEDQRECVSRQEYRKYGGAKLNRLNPGNYTARIQATSL<br>SGNGSWTDPVFFYVQAKTGYENFIHSGGGGSVPRDCGCKPCICTVPEVSSVFIFPPKPKDVLTIT<br>LTPKVTCVVVDISKDDPEVQFSWFVDDVEVHTAQTKPREEQINSTFRSVSELPIMHQDWLNGKEF<br>KCRVNSAAFPAPIEKTISKTKGRPKAPQVYTIPPPKEQMAKDKVSLTCMITNFFPEDITVEWQWN<br>GQPAENYKNTQPIMDTDGSYFVYSKLNVQKSNWEAGNTFTCSVLHEGLHNHHTEKSLSHSPGKSG<br>HHHHHH |
| 428. | murine IGF-R1 construct | artificial | nt | ATGGGATGGAGCTGTATCATCCTCTTCTTGGTAGCAACAGCTACAGGTGTACACTCCGATTACAA<br>GGACGACGATGACAAGGAAATCTGTGGGCCCGGCATTGACATCCGCAACGACTATCAGCAGCTGA<br>AGCGCCTGGAAAACTGCACGGTGATCGAGGGCTTCCTCCACATCCTGCTCATCTCCAAGGCCGAG |

| SEQ ID NO. | DESIGNATION | SOURCE | TYPE | SEQUENCE |
|---|---|---|---|---|
| | | | | GACTACCGAAGCTACCGCTTCCCCAAGCTCACCGTCATCACTGAGTACTTGCTGCTCTTCCGAGT CGCTGGCCTCGAGAGCCTGGGAGACCTCTTCCCCAACCTCACAGTCATCCGTGGCTGGAAACTCT TCTACAACTACGCACTGGTCATCTTCGAGATGACCAATCTCAAGGATATTGGGCTTTATAATCTG AGGAACATTACTCGGGGGGCCATCAGGATTGAGAAGAACGCCGACCTCTGTTACCTCTCCACCAT AGACTGGTCTCTCATCTTGGATGCGGTGTCCAATAACTACATTGTGGGGAACAAGCCCCCGAAGG AATGTGGGGACCTGTGTCCAGGGACATTGGAGGAGAAGCCCATGTGTGAGAAGACCACCATCAAC AATGAGTACAACTACCGCTGCTGGACCACAAATGCTGCCAGAAAATGTGCCCAAGTGTGTGCGG GAAGCGAGCCTGCACCGAGAACAACGAGTGCTGCCACCCGGAGTGCCTGGGCAGCTGCCACACAC CGGACGACAACAACACAACCTCCGTGGCCTGCAGACACTACTACTACAAAGGCGTCTGTGTGCCTGCC TGCCCGCCTGGCACCTACAGGTTCGAGGGCTGGCGCTGTGTGGATCGCGATTTCTGCGCCAACAT CCCCAACGCTGAGAGCAGTGACTCGGATGGCTTCGTTATCCACGACGATGAGTGCATGCAGGAGT GTCCCTCAGGCTTCATCCGCAACAGCACCCAGAGCATGTACTGTATCCCCTGCGAAGGCCCCTGC CCCAAAGTCTGCGGCGATGAAGAGAAGAAAGAAACCATCGATTCGGTGACTTCTGCTCAAAT GCTCCAAGGATGCACCATCCTGAAGGGCAATCTGCTTATTAACATCCGGAGAGGCAATAACATTG CCTCGGAGTTGGAGAACTTCATGGGGCTCATCGAGGTGGTGACCGGCTACGTGAAGATCCGCCAT TCTCATGCCTTGGTCTCCTTGTCCTTCCTGAAGAACCTTCGTCTCATCTTAGGAGAGGAGCAGCT GGAAGGGAACTACTCCTTCTATGTCCTAGACAACCAGAACTTGCAGCAGCTGTGGGACTGGAACC ACCGGAACCTGACCGTCAGGTCCGGAAAGATGTACTTTGCTTTCAATCCCAAGCTGTGTGTCTCC GAAATTTACCGCATGGAGGAAGTGACCGGAACCAAGGGACGCCAGAGCAAAGGGGACATAAACAC CAGGAACAACGGAGAGCGAGCTTCCTGTGAAAGTGATGTTCTCCGTTTCACCTCCACCACGACCT GGAAGAACCGAATCATCATAACGTGGCACCGGTACCGGCCGCCGGACTACCGGGATCTCATCAGC TTCACAGTTTACTACAAGGAGGCACCATTTAAAAACGTTACGGAATATGACGGGCAGGATGCCTG TGGCTCCAACAGCTGGAACATGGTGGATGTAGACCTGCCTCCGAACAAGGAGGGCGAGCCTGGCA TTTTACTGCATGGGCTGAAGCCCTGGACCCAGTATGCTGTCTATGTCAAGGCTGTGACCCTCACC ATGGTGGAAAACGACCATATCCGTGGGGCCAAAAGTGAAATCTTGTACATTCGCACCAATGCTTC AGTCCCTTCCATTCCCTAGATGTCCTCTCAGCATCAAACTCTTCCTCTCAGCTGATTGTGAAGT GGAATCCTCCAACTCTGCCCAATGGTAACTTGAGTTACTACATTGTGAGGTGGCAGCGGCAGCCC CAGGATGGTTACCTGTACCGGCACAACTACTGCTCCAAAGACAAAATACCCATCAGAAAGTACGC CGATGGTACCATCGACGTGGAGGAGGTGACGGAAAATCCCAAGACAGAAGTGTGTGGTGGTGATA AAGGGCCATGCTGCGCTTGCCCTAAAACTGAAGCTGAGAAGCAGGCTGAGAAGGAGGAGGCTGAG TACCGTAAAGTCTTTGAGAATTTCCTTCACAATTCCATCTTTGTGCCCAGGCCCGAAAGGAGGCG GAGAGACGTCATGCAAGTGGCCAACACGACCATGTCCAGCCGAAGCAGGAACACCACGGTAGCTG ACACCTACAATATCACAGACCCGGAGGAGTTCGAGACAGAGTACCCTTTCTTTGAGAGCAGAGTG GATAACAAGGAGAGGACTGTCATCTCCAACCTCCGGCCTTTCACTCTGTACCGCATCGATATCCA CAGCTGCAACCACGAGGCTGAGAAGCTGGGCTGCAGCGCCTCCAACTTCGTCTTTGCGAGAACCA TGCCAGCAGAAGGAGCAGATGATATCCCTGGTCCGGTGACCTGGGAGCCAAGACCCGAAAACTCC ATCTTTTTAAAGTGGCCAGAACCCGAGAACCCCAACGGATTGATCCTAATGTATGAAATTAAATA CGGGTCGCAAGTCGAGGATCAGCGGGAATGTGTGTCCAGACAGGAGTACAGGAAGTACGAGGGG CCAAACTCAACCGTCTAAACCCAGGGAACTATACAGCCCGGATTCAGGCTACCTCCCTCTCTGGG AATGGGTCATGGACAGATCCTGTGTTCTTCTATGTCCCCGCCAAAACGACGTATGAGAACTTCAT GCATCTGATCATTGCTCTGCCGGTTGCCATCCTGCTGATCGTTGGGGGGCTGGTTATCATGCTGT ATGTCTTCCATAGAAAGAGAAATAACAGCAGGTTGGGCAATGGAGTGCTGTATGCTTCTGTGAAC CCCGAGTATTTCAGCGCAGCTGATGTGTACGTGCCTGATGAATGGGAGGTAGCTCGAGAGAAGAT CACCATGAACCGGGAGCTCGGACAAGGGTCCTTTGGGATGGTCTATGAAGGAGTGGCCAAGGGTG TGGTCAAGGATGAACCCGAAACCAGAGTGGCCATCAAGACGGTAAACGAGGCTGCAAGTATGCGT GAAAGAATCGAGTTTCTCAACGAGGCCTCGGTGATGAAGGAGTTCAATTGTCACCATGTGGTCCG GTTGCTGGGTGTGGTATCCCAAGGCCAGCCCACCCTGGTCATCATGGAACTAATGACACGCGGTG ATCTCAAAAGTTATCTCCGGTCTCTGAGGCCAGAAGTGGAGCAGAATAATCTAGTCCTCATTCCT CCGAGCTTAAGCAAGATGATCCAGATGGCCGGAGAGATTGCAGATGGCATGGCCTACCTCAATGC CAACAAGTTCGTCCACAGAGACCTTGCTGCTAGGAACTGCATGGTAGCCGAAGATTTCACAGTCA AAATTGGAGATTTCGGTATGACACGAGACATCTACGAGACGGACTACTACCGGAAAGGCGGGAAG GGGTTGCTGCCTGTGCGCTGGATGTCTCCCGAGTCCCTCAAGGATGGTGTCTTCACTACTCATTC TGATGTCTGGTCCTTCGGGGTCGTCCTCTGGGAGATCGCCACGCTGGCTGAGCAGCCCTACCAGG GCTTGTCCAACGAGCAAGTTCTTCGTTTCGTCATGGAGGGTGGCCTTCTGGACAAGCCGGACAAC TGCCCTGATATGCTGTTTGAACTTATGCGCATGTGCTGGCAGTATAACCCCAAGATGCGGCCCTC CTTCCTGGAGATCATCGGCAGCATCAAGGATGAGATGGAGCCCAGCTTCCAGGAGGTCTCCTTCT ACTACAGCGAGGAGAACAAGCTCCCGGAGCCAGAGGAGCTGGAGATGGAGCCTGAGAACATGGAG AGCGTCCCACTGGACCCTTCGGCCTCCTCAGCCTCCCTGCCTCTGCCTGAAAGACACTCAGGACA CAAGGCTGAGAATGGCCCGGGCCCTGGCGTGCTCGTTCTCCGCGCCAGTTTTGATGAGAGACAGC CTTACGCTCACATGAACGGGGACGCGCCAACGAGAGGGCCTTGCCTCTGCCCCAGTCCTCGACCT GCTGA |
| 429. | murine IGF-R1 construct | artificial | aa | MGWSCIILFLVATATGVHSDYKDDDDKEICPGIDIRNDYQQLKRLENCTVIEGFLHILLISKAE DYRSYRFPKLTVITEYLLLFRVAGLESLGDLFPNLTVIRGWKLFYNYALVIFEMTNLKDIGLYNL RNITRGAIRIEKNADLCYLSTIDWSLILDAVSNNYIVGNKPPKECGDLCPGTLEEKPMCEKTTIN NEYNYRCWTTNRCQKMCPSVCGKRACTENNECCHPECLGSCHTPDDNTTCVACRHYYYKGVCVPA CPPGTYRFEGWRCVDRDFCANIPNAESSDSDGFVIHDDECMQECPSGFIRNSTQSMYCIPCEGPC PKVCGDEEKKTKTIDSVTSAQMLQGCTILKGNLLINIRRGNNIASELENFMGLIEVVTGYVKIRH SHALVSLSFLKNLRLILGEEQLEGNYSFYVLDNQNLQQLWDWNHRNLTVRSGKMYFAFNPKLCVS EIYRMEEVTGTKGRQSKGDINTRNNGERASCESDVLRFTSTTTWKNRIIITWHRYRPPDYRDLIS FTVYYKEAPFKNVTEYDGQDACGSNSWNMVDVDLPPNKEGEPGILLHGLKPWTQYAVYVKAVTLT MVENDHIRGAKSEILYIRTNASVPSIPLDVLSASNSSSQLIVKWNPPTLPNGNLSYYIVRWQRQP QDGYLYRHNYCSKDKIPIRKYADGTIDVEEVTENPKTEVCGGDKGPCCACPKTEAEKQAEKEEAE YRKVFENFLHNSIFVPRPERRRDVMQVANTTMSSRSRNTTVADTYNITDPEEFETEYPFFESRV DNKERTVISNLRPFTLYRIDIHSCNHEAEKLGCSASNFVFARTMPAEGADDIPGPVTWEPRPENS |

-continued

| SEQ ID NO. | DESIGNATION | SOURCE | TYPE | SEQUENCE |
|---|---|---|---|---|
| | | | | IFLKWPEPENPNGLILMYEIKYGSQVEDQRECVSRQEYRKYGGAKLNRLNPGNYTARIQATSLSG<br>NGSWTDPVFFYVPAKTTYENFMHLIIALPVAILLIVGGLVIMLYVFHRKRNNSRLGNGVLYASVN<br>PEYFSAADVYVPDEWEVAREKITMNRELGQGSFGMVYEGVAKGVVKDEPETRVAIKTVNEAASMR<br>ERIEFLNEASVMKEFNCHHVVRLLGVVSQGQPTLVIMELMTRGDLKSYLRSLRPEVEQNNLVLIP<br>PSLSKMIQMAGEIADGMAYLNANKFVHRDLAARNCMVAEDFTVKIGDFGMTRDIYETDYYRKGGK<br>GLLPVRWMSPESLKDGVETTHSDVWSEGVVLWEIATLAEQPYQGLSNEQVLRFVMEGGLLDKPDN<br>CPDMLFELMRMCWQYNPKMRPSFLEIIGSIKDEMEPSFQEVSFYYSEENKPPEPEELEMEPENME<br>SVPLDPSASSASLPLPERHSGHKAENGPGPGVLVLRASFDERQPYAHMNGGRANERALPLPQSST<br>C |
| 430. | mutated human IGF-R1 antigen | artificial | nt | ATGGGATGGAGCTGTATCATCCTCTTCTTGGTAGCAACAGCTACAGGTGTACACTCCGATTACAA<br>GGACGACGATGACAAGGAAATCTGTGGGCCCGGCATTGACATCCGCAACGACTATCAGCAGCTGA<br>AGCGCCTGGAAAACTGCACGGTGATCGAGGGCTTCCTCCACATCCTGCTCATCTCCAAGGCCGAG<br>GACTACCGAAGCTACCGCTTCCCCAAGCTCACCGTCATCACTGAGTACTTGCTGCTCTTCCGAGT<br>CGCTGGCCTCGAGAGCCTGGGAGACCTCTTCCCCAACCTCACAGTCATCCGTGGCTGGAAACTCT<br>TCTACAACTACGCACTGGTCATCTTCGAGATGACCAATCTCAAGGATATTGGGCTTTATAATCTG<br>AGGAACATTACTCGGGGGGCCATCAGGATTGAGAAGAACGCCGACCTCTGTTACCTCTCCACCAT<br>AGACTGGTCTCTCATCTTGGATGCGGTGTCCAATAACTACATTGTGGGGAACAAGCCCCCGAAGG<br>AATGTGGGGACCTGTGTCCAGGGACATTGGAGGAGAAGCCCATGTGTGAGAAGACCACCATCAAC<br>AATGAGTACAACTACCGCTGCTGGACCACAAATCGCTGCCAGAAAATGTGCCCAAGTGTGTGCGG<br>GAAGCGAGCCTGCACCGAGAACAACGAGTGCTGCCACCCGGAGTGCCTGGGCAGCTGCCACACAC<br>CGGACGACAACACAACCTGCGTGGCCTGCAGACACTACTACTACAAAGGCGTGTGTGTGCCTGCC<br>TGCCCGCCTGGCACCTACAGGTTCGAGGGCTGGCGCTGTGTGGATCGCGATTTCTGCGCCAACAT<br>CCCCAACGCTGAGAGCAGTGACTCGGATGGCTTCGTTATCCACGACGATGAGTGCATGCAGGAGT<br>GTCCCTCAGGCTTCATCCGCAACAGCACCCAGAGCATGTACTGTATCCCCTGCGAAGGCCCCTGC<br>CCCAAGGTCTGTGAGGAAGAAAAGAAAACAAAGACCATTGATTCTGTTACTTCTGCTCAGATGCT<br>CCAAGGATGCACCATCTTCAAGGGCAATTTGCTCATTAACATCCGACGGGGGAATAACATTGCTT<br>CAGAGCTGGAGAACTTCATGGGGCTCATCGAGGTGGTGACGGGCTACGTGAAGATCCGCCATTCT<br>CATGCCTTGGTCTCCTTGTCCTTCCTAAAAAACCTTCGCCTCATCCTAGGAGAGGAGCAGCTAGA<br>AGGGAATTACTCCTTCTACGTCCTCGACAACCAGAACTTGCAGCAACTGTGGGACTGGGACCACC<br>GCAACCTGACCATCAAAGCAGGGAAAATGTACTTTGCTTTCAATCCCAAATTATGTGTTTCCGAA<br>ATTTACCGCATGGAGGAAGTGACGGGGACTAAAGGGCGCCAAAGCAAAGGGGACATAAACACCAG<br>GAACAACGGGGAGAGAGCCTCCTGTGAAAGTGACGTCCTGCATTTCACCTCCACCACCACGTCGA<br>AGAATCGCATCATCATAACCTGGCACCGGTACCGGCCCCCTGACTACAGGGATCTCATCAGCTTC<br>ACCGTTTACTACAAGGAAGCACCCTTTAAGAATGTCACAGAGTATGATGGGCAGGATGCCTGCGG<br>CTCCAACAGCTGGAACATGGTGGACGTGGACCTCCCGCCCAACAAGGACGTGGAGCCCGGCATCT<br>TACTACATGGGCTGAAGCCCTGGACTCAGTACGCCGTTTACGTCAAGGCTGTGACCCTCACCATG<br>GTGGAGAACGACCATATCCGTGGGGCCAAGAGTGAGATCTTGTACATTCGCACCAATGCTTCAGT<br>TCCTTCCATTCCCTTGGACGTTCTTTCAGCATCGAACTCCTCTTCTCAGTTAATCGTGAAGTGGA<br>ACCCTCCCTCTCTGCCCAACGGCAACCTGAGTTACTACATTGTGCGCTGGCAGCGGCAGCCTCAG<br>GACGGCTACCTTTACCGGCACAATTACTGCTCCAAAGACAAAATCCCCATCAGGAAGTATGCCGA<br>CGGCACCATCGACATTGAGGAGGTCACAGAGAACCCCAAGACTGAGGTGTGTGGTGGGGAGAAAG<br>GGCCTTGCTGCGCCTGCCCCAAAACTGAAGCCGAGAAGCAGGCCGAGAAGGAGGAGGCTGAATAC<br>CGCAAAGTCTTTGAGAATTTCCTGCACAACTCCATCTTCGTGCCCAGACCTGAAAGGAAGCGGAG<br>AGATGTCATGCAAGTGGCCAACACCACCATGTCCAGCCGAAGCAGGAACACCACGGCCGCAGACA<br>CCTACAACATCACCGACCCGGAAGAGCTGGAGACAGAGTACCCTTTCTTTGAGAGCAGAGTGGAT<br>AACAAGGAGAGAACTGTCATTTCTAACCTTCGGCCTTTCACATTGTACCGCATCGATATCCACAG<br>CTGCAACCACGAGGCTGAGAAGCTGGGCTGCAGCGCCTCCAACTTCGTCTTTGCAAGGACTATGC<br>CCGCAGAAGGAGCAGATGACATTCCTGGGCCAGTGACCTGGGAGCCAAGGCCTGAAAACTCCATC<br>TTTTTAAAGTGGCCGGAACCTGAGAATCCCAATGGATTGATTCTAATGTATGAAATAAAATACGG<br>ATCACAAGTTGAGGATCAGCGAGAATGTGTGTCCAGACAGGAATACAGGAAGTATGGAGGGGCCA<br>AGCTAAACCGGCTAAACCCGGGGAACTACACAGCCCGGATTCAGGCCACATCTCTCTCTGGGAAT<br>GGGTCGTGGACAGATCCTGTGTTCTTCTATGTCCAGGCCAAAACAGGATATGAAAACTTCATCCA<br>TCTGATCATCGCTCTGCCCGTCGCTGTCCTGTTGATCGTGGGAGGGTTGGTGATTATGCTGTACG<br>TCTTCCATAGAAAGAGAAATAACAGCAGGCTGGGGAATGGAGTGCTGTATGCCTCTGTGAACCCG<br>GAGTACTTCAGCGCTGCTGATGTGTACGTTCCTGATGAGTGGGAGGTGGCTCGGGAGAAGATCAC<br>CATGAGCCGGGAACTTGGGCAGGGGTCGTTTGGGATGGTCTATGAAGGAGTTGCCAAGGGTGTGG<br>TGAAAGATGAACCTGAAACCAGAGTGGCCATTAAAACAGTGAACGAGGCCGCAAGCATGCGTGAG<br>AGGATTGAGTTTCTCAACGAAGCTTCTGTGATGAAGGAGTTCAATTGTCACCATGTGGTGCGATT<br>GCTGGGTGTGGTGTCCCAAGGCCAGCCAACACTGGTCATCATGGAACTGATGACACGGGGCGATC<br>TCAAAAGTTATCTCCGGTCTCTGAGGCCAGAAATGGAGAATAATCCAGTCCTAGCACCTCCAAGC<br>CTGAGCAAGATGATTCAGATGGCCGGAGAGATTGCAGACGGCATGGCATACCTCAACGCCAATAA<br>GTTCGTCCACAGAGACCTTGCTGCCCGGAATTGCATGGTAGCCGAAGATTTCACAGTCAAAATCG<br>GAGATTTTGGTATGACGCGAGATATCTATGAGACAGACTATTACCGGAAAGGAGGGAAAGGGCTG<br>CTGCCCGTGCGCTGGATGTCTCCTGAGTCCCTCAAGGATGGAGTCTTCACCACTTACTCGGACGT<br>CTGGTCCTTCGGGGTCGTCCTCTGGGAGATCGCCACACTGGCCGAGCAGCCCTACCAGGGCTTGT<br>CCAACGAGCAAGTCCTTCGCTTCGTCATGGAGGGCGGCCTTCTGGACAAGCCAGACAACTGTCCT<br>GACATGCTGTTTGAACTGATGCGCATGTGCTGGCAGTATAACCCCAAGATGAGGCCTTCCTTCCT<br>GGAGATCATCAGCAGCATCAAAGAGGAGATGGAGCCTGGCTTCCGGGAGGTCTCCTTCTACTACA<br>GCGAGGAGAACAAGCTGCCCGAGCCGGAGGAGCTGGACCTGGAGCCAGAGAACATGGAGAGCGTC<br>CCCCTGGACCCCTCGGCCTCCTCGTCCTCCCTGCCACTGCCCGACAGACACTCAGGACACAAGGC<br>CGAGAACGGCCCCGGCCCTGGGGTGCTGGTCCTCCGCGCCAGCTTCGACGAGAGACAGCCTTACG<br>CCCACATGAACGGGGGCCGCAAGAACGAGCGGGCCTTGCCGCTGCCCCAGTCTTCGACCTGCTGA |

| SEQ ID NO. | DESIGNATION | SOURCE | TYPE | SEQUENCE |
|---|---|---|---|---|
| 431. | mutated human IGF-R1 antigen | artificial | aa | MGWSCIILFLVATATGVHSDYKDDDDKEICGPGIDIRNDYQQLKRLENCTVIEGFLHILLISKAE DYRSYRFPKLTVITEYLLLFRVAGLESLGDLFPNLTVIRGWKLFYNYALVIFEMTNLKDIGLYNL RNITRGAIRIEKNADLCYLSTIDWSLILDAVSNNYIVGNKPPKECGDLCPGTLEEKPMCEKTTIN NEYNYRCWTTNRCQKMCPSVCGKRACTENNECCHPECLGSCHTPDDNTTCVACRHYYYKGVCVPA CPPGTYRFEGWRCVDRDFCANIPNAESSDSDGFVIHDDECMQECPSGFIRNSTQSMYCIPCEGPC PKVCEEEKKTKTIDSVTSAQMLQGCTIFKGNLLINIRRGNNIASELENFMGLIEVVTGYVKIRHS HALVSLSFLKNLRLILGEEQLEGNYSFYVLDNQNLQQLWDWDHRNLTIKAGKMYFAFNPKLCVSE IYRMEEVTGTKGRQSKGDINTRNNGERASCESDVLHFTSTTTSKNRIIITWHRYRPPDYRDLISF TVYYKEAPFKNVTEYDGQDACGSNSWNMVDVDLPPNKDVFPGILLHGLKPWTQYAVYVKAVTLTM VENDHIRGAKSEILYIRTNASVPSIPLDVLSASNSSSQLIVKWNPPSLPNGNLSYYIVRWQRQPQ DGYLYRHNYCSKDKIPIRKYADGTIDIEEVTENPKTEVCGGEKGPCCACPKTEAEKQAEKEEAEY RKVFENFLHNSIFVPRPERKRRDVMQVANTTMSSRSRNTTAADTYNITDPEELETEYPFFESRVD NKERTVISNLRPFTLYRIDIHSCNHEAEKLGCSASNFVFARTMPAEGADDIPGPVTWEPRPENSI FLKWPEPENPNGLILMYEIKYGSQVEDQRECVSRQEYRKYGGAKLNRLNPGNYTARIQATSLSGN GSWTDPVFFYVQAKTGYENFIHLIIALPVAVLLIVGGLVIMLYVFHRKRNNSRLGNGVLYASVNP EYFSAADVYVPDEWEVAREKITMSRELGQGSFGMVYEGVAKGVVKDEPETRVAIKTVNEAASMRE RIEFLNEASVMKEFNCHHVVRLLGVVSQGQPTLVIMELMTRGDLKSYLRSLRPEMENNPVLAPPS LSKMIQMAGEIADGMAYLNANKFVHRDLAARNCMVAEDFTVKIGDFGMTRDIYETDYYRKGGKGL LPVRWMSPESLKDGVFTTYSDVWSFGVVLWEIATLAEQPYQGLSNEQVLRFVMEGGLLDKPDNCP DMLFELMRMCWQYNPKMRPSFLEIISSIKEEMEPGFREVSFYYSEENKLPEPEELDLEPENMESV PLDPSASSSSLPLPDRHSGHKAENGPGPGVLVLRASFDERQPYAHMNGGRKNERALPLPQSSTC |
| 432. | mutated murine IGF-R1 antigen | artificial | nt | ATGGGATGGAGCTGTATCATCCTCTTCTTGGTAGCAACAGCTACAGGTGTACACTCCGATTACAA GGACGACGATGACAAGGAAATCTGCGGGCCAGGCATCGACATCCGCAACGACTATCAGCAGCTGA AGCGCCTGGAGAACTGCACGGTGATCGAGGGCTTCCTCCACATCCTGCTCATCTCCAAGGCCGAG GACTACCGCAGCTACCGCTTCCCCAAGCTCACGGTCATTACCGAGTACTTGCTGCTGTTCCGAGT GGCTGGCCTCGAGAGCCTCGGAGACCTCTTCCCCAACCTCACGGTCATCCGCGGCTGGAAACTCT TCTACAACTACGCCCTGGTCATCTTCGAGATGACCAATCTCAAGGATATTGGGCTTTACAACCTG AGGAACATTACTCGGGGGGCCATCAGGATTGAGAAAAATGCTGACCTCTGTTACCTCTCCACTGT GGACTGGTCCCTGATCCTGGATGCGGTGTCCAATAACTACATTGTGGGGAATAAGCCCCCAAAGG AATGTGGGGACCTGTGTCCAGGGACCATGGAGGAGAAGCCGATGTGTGAGAAGACCACCATCAAC AATGAGTACAACTACCGCTGCTGGACCACAAACCGCTGCCAGAAAATGTGCCCAAGCACGTGTGG GAAGCGGGCGTGCACCGAGAACAATGAGTGCTGCCACCCCGAGTGCCTGGGCAGCTGCAGCGCGC CTGACAACGACACGGCCTGTGTAGCTTGCCGCCACTACTACTATGCCGGTGTCTGTGTGCCTGCC TGCCCGCCCAACACCTACAGGTTTGAGGGCTGGCGCTGTGTGGACCGTGACTTCTGCGCCAACAT CCTCAGCGCCGAGAGCAGCGACTCCGAGGGGTTTGTGATCCACGACGGCGAGTGCATGCAGGAGT GCCCCTCGGGCTTCATCCGCAACGGCAGCCAGAGCATGTACTGCATCCCTTGTGAAGGTCCTTGC CCGAAAGTCTGCGGCGATGAAGAGAAGAAAACGAAAACCATCGATTCGGTGACTTCTGCTCAAAT GCTCCAAGGATGCACCATCCTGAAGGGCAATCTGCTTATTAACATCCGGAGAGGCAATAACATTG CCTCGGAGTTGGAGAACTTCATGGGGCTCATCGAGGTGGTGACCGGCTACGTGAAGATCCGCCAT TCTCATGCCTTGGTCTCCTTGTCCTTCCTGAAGAACCTTCGTCTCATCTTAGGAGAGGAGCAGCT GGAAGGGAACTACTCCTTCTATGTCCTAGACAACCAGAACTTGCAGCAGCTGTGGGACTGGAACC ACCGGAACCTGACCGTCAGGTCCGGAAAGATGTACTTTGCTTTCAATCCCAAGCTGTGTGTCTCC GAAATTTACCGCATGGAGGAAGTGACCGGAACCAAGGGACGCCAGAGCAAAGGGGACATAAACAC CAGGAACAACGGAGAGCGAGCTTCCTGTGAAAGTGATGTTCTCCGTTTCACCTCCACCACGACCT GGAAGAACCGAATCATCATAACGTGGCACCGGTACCGGCCGCCGGACTACCGGGATCTCATCAGC TTCACAGTTTACTACAAGGAGGCACCATTTAAAAACGTTACGGAATATGACGGGCAGGATGCCTG TGGCTCCAACAGCTGGAACATGGTGGATGTAGACCTGCCTCCGAACAAGGAGGGCGAGCCTGGCA TTTTACTGCATGGGCTGAAGCCCTGGACCCAGTATGCTGTCTATGTCAAGGCTGTGACCCTCACC ATGGTGGAAAACGACCATATCCGTGGGGCCAAAAGTGAAATCTTGTACATTCGCACCAATGCTTC AGTCCCTTCCATTCCCTAGATGTCCTCTCAGCATCAAACTCTTCCTCTCAGCTGATTGTGAAGT GGAATCCTCCAACTCTGCCCAATGGTAACTTGAGTTACTACATTGTGAGGTGGCAGCGGCAGCCC CAGGATGGTTACCTGTACCGGCACAACTACTGCTCCAAAGACAAAATACCCATCAGAAAGTACGC CGATGGTACCATCGACGTGGAGGAGGTGACGGAAAATCCCAAGACAGAAGTGTGTGGTGGTGATA AAGGGCCATGCTGCGCTTGCCCTAAAACTGAAGCTGAGAAGCAGGCTGAGAAGGAGGAGGCTGAG TACCGTAAAGTCTTTGAGAATTTCCTTCACAATTCCATCTTTGTGCCCAGGCCCGAAAGGAGGCG GAGAGACGTCATGCAAGTGGCCAACACGACCATGTCCAGCCGAAGCAGGAACACCACGGTAGCTG ACACCTACAATATCACAGACCCCGAGGAGTTCGAGACAGAGTACCCTTTCTTTGAGAGCAGAGTG GATAACAAGGAGAGGACTCTCATCTCCAACCTCCGGCCTTTCACTCTGTACCGCATCGATATCCA CAGCTGCAACCACGAGGCTGAGAAGCTGGGCTGCAGCGCCTCCAACTTCGTCTTTGCGAGAACCA TGCCAGCAGAAGGAGCAGATGATATCCCTGGTCCGGTGACCTGGGAGCCAAGACCCGAAAACTCC ATCTTTTTAAAGTGGCCAGAACCCGAGAACCCCAACGGATTGATCCTAATGTATGAAATTAAATA CGGGTCGCAAGTCGAGGATCAGCGGGAATGTGTGTCCAGACAGGAGTACAGGAAGTACGAGGGG CCAAACTCAACCGTCTAAACCCAGGGAACTATACAGCCCGGATTCAGGCTACCTCCCTCTCTGGG AATGGGTCATGGACAGATCCTGTGTTCTTCTATGTCCCCGCCAAAACGACGTATGAGAACTTCAT GCATCTGATCATTGCTCTGCCGGTTGCCATCCTGCTGATCGTTGGGGGGCTGGTTATCATGCTGT ATGTCTTCCATAGAAAGAGAAATAACAGCAGGTTGGGCAATGGAGTGCTGTATGCTTCGTGAAC CCCGAGTATTTCAGCGCAGCTGATGTGTACGTGCCTGATGAATGGGAGGTAGCTCGAGAGAAGAT CACCATGAACCGGGAGCTCGGACAAGGGTCCTTTGGGATGGTCTATGAAGGAGTGGCCAAGGGTG TGGTCAAGGATGAACCCGAAACCAGAGTGGCCATCAAGACGGTAAACGAGGCTGCAAGTATGCGT GAAAGAATCGAGTTTCTCAACGAGGCCTCGGTGATGAAGGAGTTCAATTGTCACCATGTGGTCCG GTTGCTGGGTGTGGTATCCCAAGGCCAGCCCACCCTGGTCATCATGGAACTAATGACACGCGGTG ATCTCAAAAGTTATCTCCGGTCTCTGAGGCCAGAAGTGGAGCAGAATAATCTAGTCCTCATTCCT CCGAGCTTAAGCAAGATGATCCAGATGGCTGGAGAGATTGCAGATGGCATGGCCTACCTCAATGC |

| SEQ ID NO. | DESIGNATION | SOURCE | TYPE | SEQUENCE |
|---|---|---|---|---|
| | | | | CAACAAGTTCGTCCACAGAGACCTTGCTGCTAGGAACTGCATGGTAGCCGAAGATTTCACAGTCA<br>AAATTGGAGATTTCGGTATGACACGAGACATCTACGAGACGGACTACTACCGGAAAGGCGGGAAG<br>GGGTTGCTGCCTGTGCGCTGGATGTCTCCCGAGTCCCTCAAGGATGGTGTCTTCACTACTCATTC<br>TGATGTCTGGTCCTTCGGGGTCGTCCTCTGGGAGATCGCCACGCTGGCTGAGCAGCCCTACCAGG<br>GCTTGTCCAACGAGCAAGTTCTTCGTTTCGTCATGGAGGGTGGCCTTCTGGACAAGCCGGACAAC<br>TGCCCTGATATGCTGTTTGAACTTATGCGCATGTGCTGGCAGTATAACCCCAAGATGCGGCCCTC<br>CTTCCTGGAGATCATCGGCAGCATCAAGGATGAGATGGAGCCCAGCTTCCAGGAGGTCTCCTTCT<br>ACTACAGCGAGGAGAACAAGCCTCCCGAGCCAGAGGAGCTGGAGATGGAGCCTGAGAACATGGAG<br>AGCGTCCCACTGGACCCTTCGGCCTCCTCAGCCTCCCTGCCTCTGCCTGAAAGACACTCAGGACA<br>CAAGGCTGAGAATGGCCCGGGCCCTGGCGTGCTCGTTCTCCGCGCCAGTTTTGATGAGAGACAGC<br>CTTACGCTCACATGAACGGGGACGCGCCAACGAGAGGGCCTTGCCTCTGCCCCAGTCCTCGACC<br>TGCTGA |
| 433. | mutated murine IGF-R1 antigen | artificial | aa | MGWSCIIFLVATATGVHSDYKDDDDKEICGPGIDIRNDYQQLKRLENCTVIEGYLHILLISKAE<br>DYRSYRFPKLTVITEYLLLFRVAGLESLGDLFPNLTVIRGWKLFYNYALVIFEMTNLKDIGLYNL<br>RNITRGAIRIEKNADLCYLSTVDWSLILDAVSNNYIVGNKPPKECGDLCPGTMEEKPMCEKTTIN<br>NEYNYRCWTTNRCQKMCPSTCGKRACTENNECCHPECLGSCSAPDNDTACVACRHYYYAGVCVPA<br>CPPNTYRFEGWRCVDRDFCANILSAESSDSEGFVIHDGECMQECPSGFIRNGSQSMYCIPCEGPC<br>PKVCGDEEKKTKTIDSVTSAQMLQGCTILKGNLLINIRRGNNIASELENFMGLIEVVTGYVKIRH<br>SHALVSLSFLKNLRLILGEEQLEGNYSFYVLDNQNLQQLWDWNHRNLTVRSGKMYFAFNPKLCVS<br>EIYRMEEVTGTKGRQSKGDINTRNNGERASCESDVLRFTSTTTWKNRIIITWHRYRPPDYRDLIS<br>FTVYYKEAPFKNVTEYDGQDACGSNSWNMVDVDLPPNKEGEPGILLHGLKPWTQYAVYVKAVTLT<br>MVENDHIRGAKSEILYIRTNASVPSIPLDVLSASNSSSQLIVKWNPPTLPNGNLSYYIVRWQRQP<br>QDGYLYRHNYCSKDKIPIRKYADGTIDVEEVTENPKTEVCGGDKGPCCACPKTEAEKQAEKEEAE<br>YRKVFENFLHNSIFVPRPERRRDVMQVANTTMSSRSRNTTVADTYNITDPEEFETEYPFFESRV<br>DNKERTVISNLRPFTLYRIDIHSCNHEAEKLGCSASNFVFARTMPAEGADDIPGPVTWEPRPENS<br>IFLKWPEPENPNGLILMYEIKYGSQVEDQRECVSRQEYRKYGGAKLNRLNPGNYTARIQATSLSG<br>NGSWTDPVFFYVPAKTTYENFMHLIIALPVAILLIVGGLVIMLYVFHRKRNNSRLGNGVLYASVN<br>PEYFSAADVYVPDEWEVAREKITMNRELGQGSFGMVYEGVAKGVVKDEPETRVAIKTVNEAASMR<br>ERIEFLNEASVMKEFNCHHVVRLLGVVSQGQPTLVIMELMTRGDLKSYLRSLRPEVEQNNLVLIP<br>PSLSKMIQMAGEIADGMAYLNANKFVHRDLAARNCMVAEDFTVKIGDFGMTRDIYETDYYRKGGK<br>GLLPVRWMSPESLKDGVFTTHSDVWSFGVVLWEIATLAEQPYQGLSNEQVLRFVMEGGLLDKPDN<br>CPDMLFELMRMCWQYNPKMRPSFLEIIGSIKDEMEPSFQEVSFYYSEENKPPEPEELEMEPENME<br>SVPLDPSASSASLPLPERHSGHKAENGPGPGVLVLRASFDERQPYAHMNGGRANERALPLPQSST<br>C |
| 434. | macaque IGF-R1 | artificial | nt | ATGAAGTCTGGCTCTGGAGAAGGGTCCCCGACCTCGCTGTGGGGGCTCCTGTTTCTCTCCGCCGC<br>GCTCTCGCTCTGGCCGACGAGTGGAGAAATCTGTGGGCGGGCATCGACATCCGCAACGACTATC<br>AGCAGCTGAAGCGCCTGGAGAACTGCACGGTGATCGAGGGCTACCTCCACATCCTGCTCATCTC<br>AAGGCCGAGGACTACCGCAGCTACCGCTTCCCCAAGCTCACGGTCATCACCGAGTACTTGCTGTT<br>GTTCCGAGTGGCTGGCCTAGAGAGCCTCGGAGACCTGTTCCCCAACCTCACGGTAATCCGCGGCT<br>GGAAACTCTTCTACAACTACGCCCTGGTCATCTTTGAGATGACCAATCTCAAGGATATTGGGCTT<br>TACAACCTGAGGAACATTACTCGGGGGGCCATCAGGATTGAGAAAAATGCTGACCTCTGTTACCT<br>CTCCACTGTGGACTGGTCCCTGATCCTGGATGCAGTGTCCAATAACTACATTGTGGGGAATAAGC<br>CCCCAAAGGAATGCGGGGACCTGTGTCCGGGACCATGGAGGAGAAGCCGATGTGCGAGAAGACC<br>ACCATCAACAATGAGTACAACTACCGCTGCTGGACCACAAACCGCTGCCAGAAAATGTGCCCGAG<br>TGCCTGTGGGAAGAGGGCATGCACCGAGAACAACGAGTGCTGCCACCCCGAGTGCCTGGGCAGCT<br>GCAGCGCGCCTGACAACGACACGGCCTGTGTAGCTTGCCGCCACTACTACTACGCCGGTGTCTGC<br>GTGCCTGCCTGCCCGCCCAACACCTACAGGTTTGAGGGCTGGCGCTGTGTGGACCGTGACTTCTG<br>CGCCAACATCCTCAGCGCCGAGAGCAGCGACTCCGAGGGTTTCGTGATCCACGACGGCGAGTGCA<br>TGCAGGAGTGCCCCTCAGGCTTCATCCGCAACGGCAGCCAGAGCATGTACTGCATCCCTTGTGAA<br>GGTCCTTGCCCCAAGGTCTGTGAGGAAGAAAAGAAAACAAAGACCATTGATTCTGTTACTTCTGC<br>TCAGATGCTCCAAGGATGCACCATCTTCAAGGGCAATTTGCTCATTAACATCCGACGGGGGAATA<br>ACATTGCTTCAGAACTGGAGAACTTCATGGGGCTCATCGAGGTGGTGACGGGCTACGTGAAGATC<br>CGCCATTCCCATGCCTTGGTCTCCTTGTCCTTCCTAAAAAACCTTGCCTCATCTTAGGAGAGGA<br>GCAGCTAGAAGGGAATTACTCCTTCTACGTCCTCGACAACCAGAACTTGCAGCAACTATGGGACT<br>GGAACCACCGCAACCTGACCATCAAAGCAGGGAAAATGTACTTTGCTTTCAATCCCAAATTGTGT<br>GTTTCGGAAATTTACCGCATGGAGGAAGTGACGGGGACTAAAGGGCGCAAAGCAAAGGGGACAT<br>AAACACCAGGAACAACGGGGAAAGAGCCTCCTGTGAAAGTGACGTCCTGCATTTCACCTCCACCA<br>CCACGTGGAAGAATCGCATCATCATAACCTGGCACCGGTACCGGCCCCTGACTACAGGGATCTC<br>ATCAGCTTCACCGTTTACTACAAGGAAGCACCTTTTAAGAATGTCACGGAGTATGATGGGCAGGA<br>TGCCTGCGGCTCCAACAGCTGGAACATGGTGGATGTGGACCTCCCGCCCAACAAGGACGTGGAGC<br>CCGGCATCTTACTGCATGGGCTGAAGCCCTGGACTCAGTACGCCGTTTACGTCAAGGCTGTGACC<br>CTCACCATGGTGGAGAACGACCATATCCGTGGGGCCAAGAGTGAGATCTTGTACATTCGCACCAA<br>TGCTTCAGTTCCTTCCATTCCCTTGGACGTTCTTTCAGCATCGAACTCCTCTTCTCAGTTAATCG<br>TGAAGTGGAACCCTCCCTCTCTGCCCAACGGCAACCTGAGTTACTACATTGTGCGCTGGCAGCGG<br>CAGCCTCAGGACGGCTACCTTTACCGGCACAATTACTGCTCCAAAGACAAAATCCCCATCAGGAA<br>GTATGCCGACGGCACCATTGACATTGAGGAGGTCACAGAGAACCCGAAGACTGAGGTGTGTGGTG<br>GAGAGAAAGGCCTTGCTGCGCCTCCCCAAAACTGAAGCTGAGAAGCAGGCCGAGAAGGAGGAG<br>GCTGAGTACCGCAAAGTCTTTGAGAATTTCCTGCACAACTCCATCTTTGTGCCCCAGACCTGAAAG<br>GAAGCGGAGAGATGTCATGCAAGTGGCCAACACCACCATGTCCAGCCGAAGCAGGAACACCACGG<br>TGGCAGACACCTACAACATCACAGATCTGGAAGAGCTAGAGACAGAGTACCCTTTCTTTGAGAGC<br>AGAGTGGATAATAAGGAGAGAACTGTCATTTCTAACCTTCGGCCTTTCACATTGTACCGCATTGA<br>TATCCACAGCTGCAACCACGAGGCTGAGAAACTGGGCTGCAGCGCCTCCAACTTTGTCTTTGCAA<br>GGACTATGCCTGCAGAAGGAGCAGATGACATTCCTGGGCCAGTGACCTGGGAGCCAAGGCCTGAA |

| SEQ ID NO. | DESIGNATION | SOURCE | TYPE | SEQUENCE |
|---|---|---|---|---|
| | | | | AACTCCATCTTTTTAAAGTGGCCAGAACCTGAGAATCCCAATGGATTGATTCTAATGTATGAAAT AAAATACGGATCACAAGTTGAGGATCAGCGAGAATGTGTGTCCAGACAGGAATACAGGAAGTATG GAGGGGCCAAGCTAAACCGGCTAAACCCAGGGAACTACACAGCCCGGATTCAGGCTACATCTCTC TCTGGGAATGGGTCGTGGACAGATCCTGTGTTCTTCTATGTCCAGGCCAAAACAGGATATGAAAA CTTCATCCATCTGATCATCGCTCTGCCCGTCGCTGTCCTGTTGATCGTGGGAGGGTTGGTGATCA TGCTGTACGTCTTCCATAGAAAGAGAAATAACAGCAGGCTGGGGAATGGAGTGCTGTACGCGTCT GTGAACCCGGAGTACTTCAGCGCTGCGGATGTGTACGTTCCTGATGAGTGGGAGGTGGCTCGGGA GAAGATCACCATGAGCCGGGAACTTGGGCAGGGGTCGTTTGGGATGGTCTATGAAGGAGTTGCCA AGGGTGTGGTGAAAGACGAACCTGAAACCAGAGTGGCCATTAAAACAGTGAACGAGGCCGCGAGC ATGCGTGAAAGGATCGAGTTTCTCAACGAGGCTTCTGTGATGAAGGAGTTCAATTGTCACCATGT GGTGCGGTTGCTGGGTGTGGTGTCCCAGGGCCAGCCAACGCTGGTCATCATGGAACTGATGACGC GGGGCGATCTCAAAAGTTATCTCCGGTCTCTGAGGCCAGAAATGGAGAATAATCCAGTCCTAGCA CCTCCAAGCCTAAGCAAGATGATTCAGATGGCTGGAGAGATTGCAGACGGCATGGCATACCTCAA CGCCAACAAGTTCGTCCACAGAGACTTGGCTGCCCGGAATTGCATGGTAGCCGAGGATTTCACAG TCAAAATTGGAGATTTTGGGATGACGCGAGATATCTATGAGACAGACTATTACCGGAAAGGAGGG AAAGGGCTGTTGCCCGTGCGCTGGATGTCTCCCGAGTCCCTCAAGGATGGAGTCTTCACCACTTA CTCGGACGTCTGGTCCTTCGGGGTTGTCCTCTGGGAGATCGCCACACTGGCCGAGCAGCCCTACC AGGGCTTGTCCAACGAGCAAGTCCTTCGCTTCGTCATGGAGGGCGGCCTTCTGGACAAGCCAGAC AACTGCCCCGACATGCTGTTTGAATTGATGCGCATGTGCTGGCAGTACAACCCCAAGATGAGGCC TTCCTTCCTGGAGATCATCAGCAGCATCAAAGACGAGATGGAGCCTGGCTTCCGGGAGGTCTCCT TCTACTACAGTGAGGAGAACAAGCTGCCCGAGCCGGAGGAGCTGGACCTGGAGCCAGAGAACATG GAGAGCGTCCCCCTGGACCCCTCGGCCTCTCGTCCTCCCTGCCACTGCCCGACAGACACTCAGG ACACAAGGCCGAGAACGGCCCCGGCCCTGGAGTGCTGGTGCTCCGCGCCAGCTTCGATGAGAGAC AGCCTTACGCACACATGAACGTGGCCGCAAGAACGAGCGGGCCTTGCCGCTGCCCCAGTCTTCG ACCTGCTGA |
| 435. | macaque IGF-R1 | artificial | aa | MKSGSGEGSPTSLWGLLFLSAALSLWPTSGEICGPGIDIRNDYQQLKRLENCTVIEGYLHILLIS KAEDYRSYRFPKLTVITEYLLLFRVAGLESLGDLFPNLTVIRGWKLFYNYALVIFEMTNLKDIGL YNLRNITRGAIRIEKNADLCYLSTVDWSLILDAVSNNYIVGNKPPKECGDLCPGTMEEKPMCEKT TINNEYNYRCWTTNRCQKMCPSACGKRACTENNECCHPECLGSCSAPDNDTACVACRHYYYAGVC VPACPPNTYRFEGWRCVDRDFCANILSAESSDSEGFVIHDGECMQECPSGFIRNGSQSMYCIPCE GPCPKVCEEEKKTKTIDSVTSAQMLQGCTIFKGNLLINIRRGNNIASELENFMGLIEVVTGYVKI RHSHALVSLSFLKNLRLILGEEQLEGNYSFYVLDNQNLQQLWDWDHRNLTIKAGKMYFAFNPKLC VSEIYRMEEVTGTKGRQSKGDINTRNNGERASCESDVLHFSTTTWKNRIIITWHRYRPPDYRDL ISFTVYYKEAPFKNVTEYDGQDACGSNSWNMVDVDLPPNKDVEPGILLHGLKPWTQYAVYVKAVT LTMVENDHIRGAKSEILYIRTNASVPSIPLDVLSASNSSSQLIVKWNPPSLPNGNLSYYIVRWQR QPQDGYLYRHNYCSKDKIPIRKYADGTIDIEEVTENPKTEVCGGEKGPCCACPKTEAEKQAEKEE AEYRKVFENFLHNSIFVPRPERKRRDVMQVANTTMSSRSRNTTVADTYNITDLEELETEYPFFES RVDNKERTVISNLRPFTLYRIDIHSCNHEAEKLGCSASNFVFARTMPAEGADDIPGPVTWEPRPE NSIFLKWPEPENPNGLILMYEIKYGSQVEDQRECVSRQEYRKYGGAKLNRLNPGNYTARIQATSL SGNGSWTDPVFFYVQAKTGYENFIHLIIALPVAVLLIVGGLVIMLYVFHRKRNNSRLGNGVLYAS VNPEYFSAADVYVPDEWEVAREKITMSRELGQGSFGMVYEGVAKGVVKDEPETRVAIKTVNEAAS MRERIEFLNEASVMKEFNCHHVVRLLGVVSQGQPTLVIMELMTRGDLKSYLRSLRPEMENNPVLA PPSLSKMIQMAGEIADGMAYLNANKFVHRDLAARNCMVAEDFTVKIGDFGMTRDIYETDYYRKGG KGLLPVRWMSPESLKDGVFTTYSDVWSFGVVLWEIATLAEQPYQGLSNEQVLRFVMEGGLLDKPD NCPDMLFELMRMCWQYNPKMRPSFLEIISSIKDEMEPGFREVSFYYSEENKLPEPEELDLEPENM ESVPLDPSASSSSLPLPDRHSGHKAENGPGPGVLVLRASFDERQPYAHMNGGRKNERALPLPQSS TC |
| 436. | human c-MET extracellular four Ig domains | human | aa | PAIYKVFPNSAPLEGGTRLTICGWDFGFRRNNKFDLKKTRVLLGNESCTLTLSESTMNTLKCTVG PAMNKHFNMSIIISNGHGTTQYSTFSYVDPVITSISPKYGPMAGGTLLTLTGNYLNSGNSRHISI GGKTCTLKSVSNSILECYTPAQTISTEFAVKLKIDLANRETSIFSYREDPIVYEIHPTKSFISGG STITGVGKNLNSVSVPRMINVHEAGRNFTVACQHRSNSEIICCTTPSLQQLNLQLPLKTKAFFM LDGILSKYFDLIYVHNPVFKPFEKPVMISMGNENVLEIKGNDIDPEAVKGEVLKVGNKSCENIHL HSEAVLCTVPNDLLKLNSELNIEWKQAISSTVLGKVI |
| 437. | human c-MET extracellular cystein-rich domain | human | aa | CRHFQSCSQCLSAPPFVQCGWCHDKCVRSEECLSGTWTQQIC |
| 438. | human c-MET extracellular beta-chain of a sema domain | human | aa | STKKEVFNILQAAYVSKPGAQLARQIGASLNDDILFGVFAQSKPDSAEPMDRSAMCAFPIKYVND FFNKIVNKNNVRCLQHFYGPNHEHCFNRTLLRNSSGCEARRDEYRTEFTTALQRVDLFMGQFSEV LLTSISTFIKGDLTIANLGTSEGRFMQVVVSRSGPSTPHVNFLLDSHPVSPEVIVEHTLNQNGYT LVITGKKITKIPLNGLG |
| 439. | human c-MET extracellular domain | human | aa | ECKEALAKSEMNVNMKYQLPNFTAETPIQNVILHEHHIFLGATNYIYVLNEEDLQKVAEYKTGPV LEHPDCFPCQDCSSKANLSGGVWKDNINMALVVDTYYDDQLISCGSVNRGTCQRHVFPHNHTADI QSEVHCIFSPQIEEPSQCPDCVVSALGAKVLSSVKDRFINFFVGNTINSSYFPDHPLHSISVRRL KETKDGFMFLTDQSYIDVLPEFRDSYPIKYVHAFESNNFIYFLTVQRETLDAQTFHTRIIRFCSI NSGLHSYMEMPLECILTEKRKKRSTKKEVFNILQAAYVSKPGAQLARQIGASLNDDILFGVFAQS KPDSAEPMDRSAMCAFPIKYVNDFFNKIVNKNNVRCLQHFYGPNHEHCFNRTLLRNSSGCEARRD EYRTEFTTALQRVDLFMGQFSEVLLTSISTFIKGDLTIANLGTSEGRFMQVVVSRSGPSTPHVNF LLDSHPVSPEVIVEHTLNQNGYTLVITGKKITKIPLNGLGCRHFQSCSQCLSAPPFVQCGWCHDK |

| SEQ ID NO. | DESIGNATION | SOURCE | TYPE | SEQUENCE |
|---|---|---|---|---|
| | | | | CVRSEECLSGTWTQQICLPAIYKVFPNSAPLEGGTRLTICGWDFGFRRNNKFDLKKTRVLLGNES CTLTLSESTMNTLKCTVGPAMNKHFNMSIIISNGHGTTQYSTFSYVDPVITSISPKYGPMAGGTL LTLTGNYLNSGNSRHISIGGKTCTLKSVSNSILECYTPAQTISTEFAVKLKIDLANRETSIFSYR EDPIVYEIHPTKSFISGGSTITGVKNLNSVSVPRMVINVHEAGRNFTVACQHRSNEIICCTTP SLQQLNLQLPLKTKAFFMLDGILSKYFDLIYVHNPVFKPFEKPVMISMGNENVLEIKGNDIDPEA VKGEVLKVGNKSCENIHLHSEAVLCTVPNDLLKLNSELNIEWKQAISSTVLGKVIVQPDQNF |
| 440. | human Endosialin extracellular mucin domain | human | aa | ASQDLGDELLDDGEDEEDEDEAWKAFNGGWTEMPGILWMEPTQPPDFALAYRPSFPEDREPQIPY PEPTWPPPLSAPRVPYHSSVLSVTRPVVVSATHPTLPSAHQPPVIPATHPALSRDHQIPVIAANY PDLPSAYQPGILSVSHSAQPPAHQPPMISTKYPELFPAHQSPMFPDTRVAGTQTTTHLPGIPPNH APLVTTLGAQLPPQAPDALVLRTQATQLPIIPTAQPSLTTTSRSPVSPAHQISVPAATQPAALPT LLPSQSPTNQTSPISPTHPHSKAPQIPREDGPSPKLALWLPSPAPTAAPTALGEAGLAEHSQRDD R |
| 441. | human Endosialin extracellular three EGF-like domains | human | aa | CSPDNGGCEHECVEEVDGHVSCRCTEGFRLAADGRSCEDPCAQAPCEQQCEPGGPQGYSCHCRLG FRPAEDDPHRCVDTDECQIAGVCQQMCVNYVGGFECYCSEGHELEADGISC |
| 442. | human Endosialin extracellular Sushi/SCR/CCP domain | human | aa | PAVYTTPFHLVSTEFEWLPFGSVAAVQCQAGRGASLLCVKQPEGGVGWSRAGPLC |
| 443. | human Endosialin extracellular domain | human | aa | WAAEPRAACGPSSCYALFPRRRTFLEAWRACRELGGDLATPRTPEEAQRVDSLVGAGPASRLLWI GLQRQARQCQLQRPLRGFTWTTGDQDTAFTNWAQPASGGPCPAQRCVALEASGEHRWLEGSCTLA VDGYLCQFGFEGACPALQDEAGQAGPAVYTTPFHLVSTEFEWLPFGSVAAVQCQAGRGASLLCVK QPEGGVGWSRAGPLCLGTGCSPDNGGCEHECVEEVDGHVSCRCTEGFRLAADGRSCEDPCAQAPC EQQCEPGGPQGYSCHCRLGFRPAEDDPHRCVDTDECQIAGVCQQMCVNYVGGFECYCSEGHELEA DGISCSPAGAMGAQASQDLGDELLDDGEDEEDEDEAWKAFNGGWTEMPGILWMEPTQPPDFALAY RPSFPEDREPQIPYPEPTWPPPLSAPRVPYHSSVLSVTRPVVVSATHPTLPSAHQPPVIPATHPA LSRDHQIPVIAANYPDLPSAYQPGILSVSHSAQPPAHQPPMISTKYPELFPAHQSPMFPDTRVAG TQTTTHLPGIPPNHAPLVTTLGAQLPPQAPDALVLRTQATQLPIIPTAQPSLTTTSRSPVSPAHQ ISVPAATQPAALPTLLPSQSPTNQTSPISPTHPHSKAPQIPREDGPSPKLALWLPSPAPTAAPTA LGEAGLAEHSQRDDR |
| 444. | human IGF-R1 extracellular three fibronectin type III domains | human | aa | SDVLHFTSTTTSKNRIIITWHRYRPPDYRDLISFTVYYKEAPFKNVTEYDGQDACGSNSWNMVDV DLPPNKDVEPGILLHGLKPWTQYAVYVKAVTLTMVENDHIRGAKSEILYIRTNASVPSIPLDVLS ASNSSSQLIVKWNPPSLPNGNLSYYIVRWQRQPQDGYLRHNYCSKDKIPIRKYADGTIDIEEVT ENPKTEVCGGEKGPCCACPKTEAEKQAEKEEAEYRKVFENFLHNSIFVPRPERKRRDVMQVANTT MSSRSRNTTAADTYNITDPEELETEYPFFESRVDNKERTVISNLRPFTLYRIDIHSCNHEAEKLG CSASNFVFARTMPAEGADDIPGPVTWEPRPENSIFLKWPEPENPNGLILMYEIKYGSQVEDQREC VSRQEYRKYGGAKLNRLNPGNYTARIQATSLSGNGSWTDPVFFYVQAKTGYENFIHL |
| 445. | human IGF-R1 extracellular L2 domain | human | aa | KVCEEEKKTKTIDSVTSAQMLQGCTIFKGNLLINIRRGNNIASELENFMGLIEVVTGYVKIRHSH ALVSLSFLKNLRLILGEEQLEGNYSFYVLDNQNLQQLWDWDHRNLTIKAGKMYFAFNPKLCVSEI YRMEEVTGTKGRQSKGDINTRNNGERASCE |
| 446. | human IGF-R1 extracellular domain | human | aa | EICGPGIDIRNDYQQLKRLENCTVIEGYLHILLISKAEDYRSYRFPKLTVITEYLLLFRVAGLES LGDLFPNLTVIRGWKLFYNYALVIFEMTNLKDIGLYNLRNITRGAIRIEKNADLCYLSTVDWSLI LDAVSNNYIVGNKPPKECGDLCPGTMEEKPMCEKTTINNEYNYRCWTTNRCQKMCPSTCGKRACT ENNECCHPECLGSCSAPDNDTACVACRHYYYAGVCVPACPPNTYRFEGWRCVDRDFCANILSAES SDSEGFVIHDGECMQECPSGFIRNGSQSMYCIPCEGPCPKVCEEEKKTKTIDSVTSAQMLQGCTI FKGNLLINIRRGNNIASELENFMGLIEVVTGYVKIRHSHALVSLSFLKNLRLILGEEQLEGNYSF YVLDNQNLQQLWDWDHRNLTIKAGKMYFAFNPKLCVSEIYRMEEVTGTKGRQSKGDINTRNNGER ASCESDVLHFTSTTTSKNRIIITWHRYRPPDYRDLISFTVYYKEAPFKNVTEYDGQDACGSNSWN MVDVDLPPNKDVEPGILLHGLKPWTQYAVYVKAVTLTMVENDHIRGAKSEILYIRTNASVPSIPL DVLSASNSSSQLIVKWNPPSLPNGNLSYYIVRWQRQPQDGYLRHNYCSKDKIPIRKYADGTIDI EEVTENPKTEVCGGEKGPCCACPKTEAEKQAEKEEAEYRKVFENFLHNSIFVPRPERKRRDVMQV ANTTMSSRSRNTTAADTYNITDPEELETEYPFFESRVDNKERTVISNLRPFTLYRIDIHSCNHEA EKLGCSASNFVFARTMPAEGADDIPGPVTWEPRPENSIFLKWPEPENPNGLILMYEIKYGSQVED QRECVSRQEYRKYGGAKLNRLNPGNYTARIQATSLSGNGSWTDPVFFYVQAKTGYENFIHL |
| 447. | human PSMA extracellular domain | human | aa | KSSNEATNITPKHNMKAFLDELKAENIKKFLYNFTQIPHLAGTEQNFQLAKQIQSQWKEFGLDSV ELAHYDVLLSYPNKTHPNYISIINEDGNEIFNTSLFEPPPPGYENVSDIVPPFSAFSPQGMPEGD LVYVNYARTEDFFKLERDMKINCSGKIVIARYGKVFRGNKVKNAQLAGAKGVILYSDPADYFAPG VKSYPDGWNLPGGGVQRGNILNLNGAGDPLTPGYPANEYAYRRGIAEAVGLPSIPVHPIGYYDAQ KLLEKMGGSAPPDSSWRGSLKVPYNVGPGFTGNFSTQKVKMHIHSTNEVTRIYNVIGTLRGAVEP DRYVILGGHRDSWVFGGIDPQSGAAVVHEIVRSFGTLKKEGWRPRRTILFASWDAEEFGLLGSTE WAEENSRLLQERGVAYINADSSIEGNYTLRVDCTPLMYSLVHNLTKELKSPDEGFEGKSLYESWT KKSPSPEFSGMPRISKLGSGNDFEVFFQRLGIASGRARYTKNWETNKFSGYPLYHSVYETYELVE KFYDPMFKYHLTVAQVRGGMVFELANSIVLPFDCRDYAVVLRKYADKIYSISMKHPQEMKTYSVS |

| SEQ ID NO. | DESIGNATION | SOURCE | TYPE | SEQUENCE |
|---|---|---|---|---|
| | | | | FDSLFSAVKNFTEIASKFSERLQDFDKSNPIVLRMMNDQLMFLERAFIDPLGLPDRPFYRHVIYA PSSHNKYAGESFPGIYDALFDIESKVDPSKAWGEVKRQIYVAAFTVQAAAETLSEVA |
| 448. | human FAPα extracellular domain | human | aa | RPSRVHNSEENTMRALTLKDILNGTFSYKTFFPNWISGQEYLHQSADNNIVLYNIETGQSYTILS NRTMKSVNASNYGLSPDRQFVYLESDYSKLWRYSYTATYYIYDLSNGEFVRGNELPRPIQYLCWS PVGSKLAYVYQNNIYLKQRPGDPPFQITFNGRENKIFNGIPDWVYEEEMLATKYALWWSPNGKFL AYAEFNDTDIPVIAYSYYGDEQYPRTINIPYPKAGAKNPVVRIFIIDTTYPAYVGPQEVPVPAMI ASSDYYFSWLTWVTDERVCLQWLKRVQNVSVLSICDFREDWQTWDCPKTQEHIEESRTGWAGGFF VSTPVFSYDAISYYKIFSDKDGYKHIHYIKDTVENAIQITSGKWEAINIFRVTQDSLFYSSNEFE EYPGRRNIYRISIGSYPPSKKCVTCHLRKERCQYYTASFSDYAKYYALVCYGPGIPISTLHDGRT DQEIKILEENKELENALKNIQLPKEEIKKLEVDEITLWYKMILPPQFDRSKKYPLLIQVYGGPCS QSVRSVFAVNWISYLASKEGMVIALVDGRGTAFQGDKLLYAVYRKLGVYEVEDQITAVRKFIEMG FIDEKRIAIWGWSYGGYVSSLALASGTGLFKCGIAVAPVSSWEYYASVYTERFMGLPTKDDNLEH YKNSTVMARAEYFRNVDYLLIHGTADDNVHFQNSAQIAKALVNAQVDFQAMWYSDQNHGLSGLST NHLYTHMTHFLKQCFSLSD |
| 449. | primer 5'P6-VH-A-XhoI | artificial | aa | CTT GAT CTC GAG TCC GGC SCT GAG STG RWG AAG CCT GGC GCC TCC GTG AAG RTG TCC TGC AAG GCC TCC GGC TAC |
| 450. | primer 3'P6-VH-B | artificial | aa | CCA TTC CAG CMS CTG GCC GGG TKY CTG TYT CAC CCA GTG CAT CAC GTA GCC GGT GAA GGT GTA GCC GGA GGC CTT GCA |
| 451. | primer 5'P6-VH-C | artificial | aa | CCC GGC CAG SKG CTG GAA TGG ATS GGC TAC ATC AAC CCT TAC AAC GAC GTG ACC CGG TAC AAC GGC AAG TTC AAG |
| 452. | primer 3'P6-VH-D | artificial | aa | TTC CAT GTA GGC GGT GGA GGM GKA CKT GTC KCT GGT AAK GGT GRC TYT GCC CTT GAA CTT GCC GTT GTA |
| 453. | primer 5'P6-VH-E | artificial | aa | TCC ACC GCC TAC ATG GAA CTG TCC RGC CTG ASG TCT GAG GAC ACC GCC GTG TAC TAC TGC GCC AGG GGC |
| 454. | primer 3'P6-VH-F-BstEII | artificial | aa | CGA TAC GGT GAC CAG AGT GCC TCT GCC CCA GGA GTC GAA GTA GTA CCA GTT CTC GCC CCT GGC GCA GTA GTA |
| 455. | primer 5'P6-VL-A-SacI | artificial | aa | CTT GAT GAG CTC GTG ATG ACC CAG TCT CCA SYC TCC CTG SCT GTG ACT CTG GGC CAG CSG GCC TCC ATC TCT TGC CGG |
| 456. | primer 3'P6-VL-B | artificial | aa | CCA GTG CAT GAA GGT GTT GTC GTA GGA GTC GAT GGA CTC GGA GGC CCG GCA AGA GAT GGA GGC |
| 457. | primer 5'P6-VL-C | artificial | aa | ACC TTC ATG CAC TGG TWT CAG CAG ARG CCT GGC CAG GCT CCT MRC CKG CTG ATC TWC CGG GCC TCT ATC CTG GAA |
| 458. | primer 3'P6-VL-D | artificial | aa | CAG GGT GAA GTC GGT GCC GGA GCC AGA GCC GGA GAA CCG GKC AGG GAY GCC GGA TTC AGG ATA GAG GCC CG |
| 459. | primer 5'P6-VL-E | artificial | aa | ACC GAC TTC ACC CTG AMA ATC TMC CST GTG GAG GCC GAS GAC GTG GSC RYC TAC TAC TGC CAC CAG |
| 460. | primer 3'P6-VL-F-BsiWI/ SpeI | artificial | aa | ACT CAG ACT AGT CGT ACG CTT GAT TTC CAG CTT GGT CCC TCC GCC GAA GGT GTA AGG GTC CTC GAT GGA CTG GTG GCA GTA GTA |
| 461. | huPSMArat140-169 | artificial | nt | ATGTGGAATCTGCTTCACGAAACAGACTCGGCTGTCGCCACCGCGCGGCGCCCGCGGTGGCTGTG CGCCGGGGCGCTGGTCCTGGCGGGTGGATTCTTTTCTCCTGGGCTTCCTCTTTGGGTGGTTTATCA AATCCTCCAACGAAGCTACTAATATTACTCCAAAACATAATATGAAGGCATTTTTGGACGAATTG AAAGCCGAGAACATCAAAAAGTTCTTATACAATTTTACCCAGATACCACACTTAGCAGGAACCGA ACAAAACTTCCAGCTTGCAAAACAAATTCAATCTCAGTGGAAAGAGTTTGGCCTGGACTCTGTTG AGCTGGCACATTATGACGTCCTGTTGTCTTACCCAAATAAAACTCATCCCAATTACATCTCAATC ATTAATGAAGACGGAAATGAGATCTTCAAAACATCATTAGCTGAACTGTCCACCCCCGGGATATGA GAACATATCAGATGTAGTGCCACCATACAGTGCCTTCTCTCCACAAGGGACACCCGAGGGGGACC TAGTGTATGTGAACATGCACGGACTGAAGACTTTTTTAAATTGGAGCGGGACATGAAGATCAAT TGCTCCGGGAAAATTGTGATTGCCAGATACGGGAAAGTTTTTAGAGGAAATAAAGTTAAAAATGC TCAGCTGGCAGGCGCCAAAGGAGTGATTCTCTACTCTGACCCTGCTGATTACTTTGCTCCCGGG TGAAGTCATATCCAGATGGCTGGAATCTTCCCGGAGGTGGTGTGCAGCGTGGAAACATCCTAAAT CTCAATGGTGCAGGCGACCCTCTCACCCCAGGTTACCCCGCAAATGAATACGCTTATAGGCGGGG AATTGCAGAAGCTGTTGGTCTGCCAAGTATTCCAGTTCATCCAATCGGATACTATGACGCACAGA AGCTGCTAGAAAAGATGGGTGGCTCCGCACCACCAGACAGCAGCTGGAGGGGAAGTCTCAAGGTG CCCTACAACGTTGGACCTGGATTTACTGGAAATTTTTACTACACAGAAAGTCAAAATGCACATCCA TTCTACCAATGAGGTGACAAGAATCTACAATGTGATCGGTACTCTCAGGGGAGCAGTGGAGCCAG ACAGGTATGTCATTCTCGGAGGTCACCGCGACTCATGGGTCTTTGGTGGTATCGACCCTCAGAGC GGAGCAGCTGTGGTTCATGAAATCGTGAGGAGCTTCGGAACACTGAAGAAGGAAGGCTGGAGACC TAGGAGAACAATCTTGTTTGCAAGTTGGGATGCAGAGGAATTTGGTCTGCTTGGTTCTACCGAGT GGGCAGAAGAGAACTCAAGACTCCTGCAAGAGCGTGGAGTGGCCTTATATCAATGCTGACTCCTCT ATAGAAGGCAACTACACCCTGAGAGTTGACTGTACACCCCTGATGTACAGTTTGGTACACAATCT |

| SEQ ID NO. | DESIGNATION | SOURCE | TYPE | SEQUENCE |
|---|---|---|---|---|
| | | | | AACAAAAGAACTGAAAAGCCCCGATGAAGGCTTCGAAGGCAAATCCCTTTATGAAAGCTGGACTA AAAAGAGTCCTTCCCCTGAGTTCAGTGGAATGCCCAGGATCAGCAAATTGGGCTCTGGAAATGAC TTTGAGGTGTTTTTCCAACGACTGGGAATTGCTTCCGGCAGAGCACGCTATACTAAAAACTGGGA AACAAATAAATTCAGTGGCTATCCCCTGTATCACAGCGTCTATGAAACCTATGAGTTGGTCGAAA AGTTTTACGATCCAATGTTCAAATATCACCTGACTGTGGCTCAGGTTCGAGGCGGGATGGTGTTC GAGCTAGCCAACTCCATAGTGCTGCCTTTTGATTGCCGAGATTATGCCGTAGTTTTAAGGAAGTA TGCTGATAAAATCTACAGCATTTCTATGAAGCATCCACAGGAGATGAAGACATATAGTGTATCAT TCGATTCACTTTTCTCTGCAGTGAAGAATTTTACCGAAATTGCTTCTAAGTTTAGTGAGAGGCTC CAGGACTTCGACAAAAGCAATCCAATAGTATTGAGAATGATGAACGATCAACTGATGTTTCTGGA GAGAGCATTTATCGATCCATTAGGCTTACCAGACCGCCCTTTTTATAGACATGTCATCTACGCTC CAAGCAGTCACAACAAGTACGCAGGGGAGTCCTTCCCAGGAATCTATGATGCCCTGTTTGACATT GAAAGCAAGGTGGACCCTTCTAAGGCCTGGGCGAAGTGAAGAGGCAGATTTATGTGGCAGCCTT CACCGTGCAGGCAGCCGCAGAGACCTTGAGTGAGGTAGCCTCCGGGGATTACAAGGACGACGATG ACAAGTAA |
| 462. | huPSMArat140- 169 | artificial | aa | MWNLLHETDSAVATARRPRWLCAGALVLAGGFFLLGFLFGWFIKSSNEATNITPKHNMKAFLDEL KAENIKKFLYNFTQIPHLAGTEQNFQLAKQIQSQWKEFGLDSVELAHYDVLLSYPNKTHPNYISI INEDGNEIFKTSLAELSPPGYENISDVVPPYSAFSPQGTPEGDLVYVNYARTEDFFKLERDMKIN CSGKIVIARYGKVFRGNKVKNAQLAGAKGVILYSDPADYFAPGVKSYPDGWNLPGGGVQRGNILN LNGAGDPLTPGYPANEYAYRRGIAEAVGLPSIPVHPIGYYDAQKLLEKMGGSAPPDSSWRGSLKV PYNVGPGFTGNFSTQKVKMHIHSTNEVTRIYNVIGTLRGAVEPDRYVILGGHRDSWVFGGIDPQS GAAVVHEIVRSFGTLKKEGWRPRRTILFASWDAEEFGLLGSTEWAEENSRLLQERGVAYINADSS IEGNYTLRVDCTPLMYSLVHNLTKELKSPDEGFEGKSLYESWTKKSPSPEFSGMPRISKLGSGND FEVFFQRLGIASGRARYTKNWETNKFSGYPLYHSVYETYELVEKFYDPMFKYHLTVAQVRGGMVF ELANSIVLPFDCRDYAVVLRKYADKIYSISMKHPQEMKTYSVSFDSLFSAVKNFTEIASKFSERL QDFDKSNPIVLRMMNDQLMFLERAFIDPLGLPDRPFYRHVIYAPSSHNKYAGESFPGIYDALFDI ESKVDPSKAWGEVKRQIYVAAFTVQAAAETLSEVASGDYKDDDDK |
| 463. | huPSMArat281- 284 | artificial | nt | ATGTGGAATCTGCTTCACGAAACAGACTCGGCTGTCGCCACCGCGCGGCGCCCGCGGTGGCTGTG CGCCGGGGCGCTGGTCCTGGCGGGTGGATTCTTTCTCCTGGGCTTCCTCTTTGGGTGGTTTATCA AATCCTCCAACGAAGCTACTAATATTACTCCAAAACATAATATGAAGGCATTTTTGGACGAATTG AAAGCCGAGAACATCAAAAAGTTCTTATACAATTTTACCCAGATACCACACTTAGCAGGAACCGA ACAAAACTTCCAGCTTGCAAAACAAATTCAATCTCAGTGGAAAGAGTTTGGCCTGGACTCTGTTG AGCTGGCACATTATGACGTCCTGTTGTCTTACCCAAATAAAACTCATCCCAATTACATCTCAATC ATTAATGAAGACGGGAATGAGATCTTCAACACATCCTTATTTGAACCCCCTCCTCCAGGCTATGA AAATGTGTCGGATATTGTGCCACCTTTCAGCGCTTTCTCTCCCAAGGAATGCCCGAGGGCGACC TAGTGTATGTGAACTATGCACGGACTGAAGACTTTTTTAAATTGGAGCGGGACATGAAGATCAAT TGCTCCGGGAAAATTGTGATTGCCAGATACGGGAAAGTTTTTAGAGGAAATAAAGTTAAAAATGC TCAGCTGGCAGGCGCCAAAGGAGTGATTCTCTACTCTGACCCTGCTGATTACTTTGCTCCCGGG TGAAGTCATATCCAGATGGCTGGAATCTTCCCGGAGGTGGTGTGCAGCGTGGAAACATCCTAAAT CTCAATGGTGCAGGCGACCCGTTAACCCCAGGTTACCCCGCAAATGAATACGCTTATAGGCATGA GTTCACAGAAGCTGTTGGTCTGCCAAGTATTCCAGTTCATCCAATCGGATACTATGACGCACAGA AGCTGCTAGAAAAGATGGGTGGCTCCGCACCACCAGACAGCAGCTGGAGGGGAAGCTTGAAGGTG CCCTACAACGTTGGACCTGGATTTACTGGAAATTTTTCTACACAGAAAGTCAAAATGCACATCCA TTCTACCAATGAGGTGACAAGAATCTACAATGTGATCGGTACTCTCAGGGGAGCAGTGGAGCCAG ACCGGTATGTCATTCTCGGAGGTCACCGCGACTCATGGGTCTTTGGTGGTATCGACCCTCAGAGC GGAGCAGCTGTGGTTCATGAAATCGTGAGGAGCTTCGGAACACTGAAGAAGGAAGGCTGGAGACC TAGGAGAACAATCTTGTTTGCAAGTTGGGATGCAGAGGAATTTGGTCTGCTTGGTTCTACCGAGT GGGCAGAAGAGAACTCAAGACTCCTGCAAGAGCGTGGAGTGGCTTATATCAATGCTGACTCCTCT ATAGAAGGCAACTACACCCTGAGAGTTGACTGTACACCCCTGATGTACAGTTTGGTACACAATCT AACAAAAGAACTGAAAAGCCCCGATGAAGGCTTCGAAGGCAAATCCCTTTATGAAAGCTGGACTA AAAAGAGTCCTTCCCCTGAGTTCAGTGGAATGCCCAGGATCAGCAAATTGGGCTCTGGAAATGAC TTTGAGGTGTTTTTCCAACGACTGGGAATTGCTTCCGGCAGAGCACGCTATACTAAAAACTGGGA AACAAATAAATTCAGTGGCTATCCCCTGTATCACAGCGTCTATGAAACCTATGAGTTGGTCGAAA AGTTTTACGATCCAATGTTCAAATATCACCTGACTGTGGCTCAGGTTCGAGGCGGGATGGTGTTC GAGCTAGCCAACTCCATAGTGCTGCCTTTTGATTGCCGAGATTATGCCGTAGTTTTAAGGAAGTA TGCTGATAAAATCTACAGCATTTCTATGAAGCATCCACAGGAGATGAAGACATATAGTGTATCAT TCGATTCACTTTTCTCTGCAGTGAAGAATTTTACCGAAATTGCTTCTAAGTTTAGTGAGAGGCTC CAGGACTTCGACAAAAGCAATCCAATAGTATTGAGAATGATGAACGATCAACTGATGTTTCTGGA GAGAGCATTTATCGATCCATTAGGCTTACCAGACCGCCCTTTTTATAGACATGTCATCTACGCTC CAAGCAGTCACAACAAGTACGCAGGGGAGTCCTTCCCAGGAATCTATGATGCCCTGTTTGACATT GAAAGCAAGGTGGACCCTTCTAAGGCCTGGGCGAAGTGAAGAGGCAGATTTATGTGGCAGCCTT CACCGTGCAGGCAGCCGCAGAGACCTTGAGTGAGGTAGCCTCCGGGGATTACAAGGACGACGATG ACAAGTAA |
| 464. | huPSMArat281- 284 | artificial | aa | MWNLLHETDSAVATARRPRWLCAGALVLAGGFFLLGFLFGWFIKSSNEATNITPKHNMKAFLDEL KAENIKKFLYNFTQIPHLAGTEQNFQLAKQIQSQWKEFGLDSVELAHYDVLLSYPNKTHPNYISI INEDGNEIFNTSLFEPPPPGYENVSDIVPPFSAFSPQGMPEGDLVYVNYARTEDFFKLERDMKIN CSGKIVIARYGKVFRGNKVKNAQLAGAKGVILYSDPADYFAPGVKSYPDGWNLPGGGVQRGNILN LNGAGDPLTPGYPANEYAYRHEFTEAVGLPSIPVHPIGYYDAQKLLEKMGGSAPPDSSWRGSLKV PYNVGPGFTGNFSTQKVKMHIHSTNEVTRIYNVIGTLRGAVEPDRYVILGGHRDSWVFGGIDPQS GAAVVHEIVRSFGTLKKEGWRPRRTILFASWDAEEFGLLGSTEWAEENSRLLQERGVAYINADSS IEGNYTLRVDCTPLMYSLVHNLTKELKSPDEGFEGKSLYESWTKKSPSPEFSGMPRISKLGSGND FEVFFQRLGIASGRARYTKNWETNKFSGYPLYHSVYETYELVEKFYDPMFKYHLTVAQVRGGMVF ELANSIVLPFDCRDYAVVLRKYADKIYSISMKHPQEMKTYSVSFDSLFSAVKNFTEIASKFSERL |

| SEQ ID NO. | DESIGNATION | SOURCE | TYPE | SEQUENCE |
|---|---|---|---|---|
| | | | | QDFDKSNPIVLRMMNDQLMFLERAFIDPLGLPDRPFYRHVIYAPSSHNKYAGESFPGIYDALFDI ESKVDPSKAWGEVKRQIYVAAFTVQAAAETLSEVASGDYKDDDDK |
| 465. | huPSMArat300-344 | artificial | nt | ATGTGGAATCTGCTTCACGAAACAGACTCGGCTGTCGCCACCGCGCGGCGCCCGCGGTGGCTGTG CGCCGGGGCGCTGGTCCTGGCGGGTGGATTCTTTCTCCTGGGCTTCCTCTTTGGGTGGTTTATCA AATCCTCCAACGAAGCTACTAATATTACTCCAAAACATAATATGAAGGCATTTTTGGACGAATTG AAAGCCGAGAACATCAAAAAGTTCTTATACAATTTTACCCAGATACCACACTTAGCAGGAACCGA ACAAAACTTCCAGCTTGCAAAACAAATTCAATCTCAGTGGAAAGAGTTTGGCCTGGACTCTGTTG AGCTGGCACATTATGACGTCCTGTTGTCTTACCCAAATAAAACTCATCCCAATTACATCTCAATC ATTAATGAAGACGGAAATGAGATCTTCAACACATCCTTATTTGAACCCCCTCCTCCAGGCTATGA AAATGTGTCGGATATTGTGCCACCTTTCAGCGCTTTCTCTCCCAAGGAATGCCCGAGGGCGACC TAGTGTATGTGAACTATGCACGGACTGAAGACTTTTTTAAATTGGAGCGGGACATGAAGATCAAT TGCTCCGGGAAAATTGTGATTGCCAGATACGGGAAGTTTTTAGAGGAAATAAAGTTAAAAATGC TCAGCTGGCAGGCGCCAAAGGAGTGATTCTCTACTCTGACCCTGCTGATTACTTTGCTCCCGGG TGAAGTCATATCCAGATGGCTGGAATCTTCCCGGAGGTGGTGTGCAGCGTGGAAACATCCTAAAT CTCAATGGTGCAGGCGACCCGTTAACCCCAGGTTACCCCGCAAATGAATACGCTTATAGGCGGG AATTGCAGAAGCTGTTGGTCTGCCAAGTATTCCAGTTCATCCAATCGGATACGATGATGCCCAGA AACTATTAGAACATATGGGTGGCTCCGCACCCCCTGACAGCAGCTGGAAGGGAGGACTAAAAGTG CCTTACAACGTGGGACCTGGCTTCGCTGGAAACTTCTCAAAACAAAAGGTCAAGCTGCACATCCA TTCTACCAATGAGGTGACAAGAATCTACAATGTGATCGGTACTCTCAGGGGAGCAGTGGAGCCAG ACCGGTATGTCATTCTCGGAGGTCACCGCGACTCATGGGTCTTTGGTGGTATCGACCCTCAGAGC GGAGCAGCTGTGGTTCATGAAATCGTGAGGAGCTTCGGAACACTGAAGAAGGAAGGCTGGAGACC TAGGAGAACAATCTTGTTTGCAAGTTGGGATGCAGAGGAATTTGGTCTGCTTGGTTCTACCGAGT GGGCAGAAGAGAACTCAAGACTCCTGCAAGAGCGTGGAGTGGCTTATATCAATGCTGACTCCTCT ATAGAAGGCAACTACACCCTGAGAGTTGACTGTACACCCCTGATGTACAGTTTGGTACACAATCT AACAAAGAACTGAAAAGCCCCGATGAAGGCTTCGAGGCAAATCCCTTTATGAAAGCTGGACTA AAAAGAGTCCTTCCCCTGAGTTCAGTGGAATGCCCAGGATCAGCAAATTGGGCTCTGGAAATGAC TTTGAGGTGTTTTTCCAACGACTGGGAATTGCTTCCGGCAGAGCACGCTATACTAAAAACTGGGA AACAAATAAATTCAGTGGCTATCCCCTGTATCACAGCGTCTATGAAACCTATGAGTTGGTCGAAA AGTTTTACGATCCAATGTTCAAATATCACCTGACTGTGGCTCAGGTTCGAGGCGGGATGGTGTTC GAGCTAGCCAACTCCATAGTGCTGCCTTTTGATTGCCGAGATTATGCCGTAGTTTTAAGGAAGTA TGCTGATAAAATCTACAGCATTTCTATGAAGCATCCACAGGAGATGAAGACATATAGTGTATCAT TCGATTCACTTTTCTCTGCAGTGAAGAATTTTACCGAAATTGCTTCTAAGTTTAGTGAGAGGCTC CAGGACTTCGACAAAAGCAATCCAATAGTATTGAGAATGATGAACGATCAACTGATGTTTCTGGA GAGAGCATTTATCGATCCATTAGGCTTACCAGACCGCCCTTTTTATAGACATGTCATCTACGCTC CAAGCAGTCACAACAAGTACGCAGGGGAGTCCTTCCCAGGAATCTATGATGCCCTGTTTGACATT GAAAGCAAGGTGGACCTTCTAAGGCCTGGGGCGAAGTGAAGAGGCAGATTTATGTGGCAGCCTT CACCGTGCAGGCAGCCGCAGAGACCTTGAGTGAGGTAGCCTCCGGGGATTACAAGGACGACGATG ACAAGTAA |
| 466. | huPSMArat300-344 | artificial | aa | MWNLLHETDSAVATARRPRWLCAGALVLAGGFFLLGFLFGWFIKSSNEATNITPKHNMKAFLDEL KAENIKKFLYNFTQIPHLAGTEQNFQLAKQIQSQWKEFGLDSVELAHYDVLLSYPNKTHPNYISI INEDGNEIFNTSLFEPPPPGYENVSDIVPPFSAFSPQGMPEGDLVYVNYARTEDFFKLERDMKIN CSGKIVIARYGKVFRGNKVKNAQLAGAKGVILYSDPADYFAPGVKSYPDGWNLPGGGVQRGNILN LNGAGDPLTPGYPANEYAYRRGIAEAVGLPSIPVHPIGYDDAQKLLEHMGGSAPPDSSWKGGLKV PYNVGPGFAGNFSKQKVKLHISHSTNEVTRIYNVIGTLRGAVEPDRYVILGGHRDSWVFGGIDPQS GAAVVHEIVRSFGTLKKEGWRPRRTILFASWDAEEFGLLGSTEWAEENSRLLQERGVAYINADSS IEGNYTLRVDCTPLMYSLVHNLTKELKSPDEGFEGKSLYESWTKKSPSPEFSGMPRISKLGSGND FEVFFQRLGIASGRARYTKNWETNKFSGYPLYHSVYETYELVEKFYDPMFKYHLTVAQVRGGMVF ELANSIVLPFDCRDYAVVLRKYADKIYSISMKHPQEMKTYSVSFDSLFSAVKNFTEIASKFSERL QDFDKSNPIVLRMMNDQLMFLERAFIDPLGLPDRPFYRHVIYAPSSHNKYAGESFPGIYDALFDI ESKVDPSKAWGEVKRQIYVAAFTVQAAAETLSEVASGDYKDDDDK |
| 467. | huPSMArat598-617 | artificial | nt | ATGTGGAATCTGCTTCACGAAACAGACTCGGCTGTCGCCACCGCGCGGCGCCCGCGGTGGCTGTG CGCCGGGGCGCTGGTCCTGGCGGGTGGATTCTTTCTCCTGGGCTTCCTCTTTGGGTGGTTTATCA AATCCTCCAACGAAGCTACTAATATTACTCCAAAACATAATATGAAGGCATTTTTGGACGAATTG AAAGCCGAGAACATCAAAAAGTTCTTATACAATTTTACCCAGATACCACACTTAGCAGGAACCGA ACAAAACTTCCAGCTTGCAAAACAAATTCAATCTCAGTGGAAAGAGTTTGGCCTGGACTCTGTTG AGCTGGCACATTATGACGTCCTGTTGTCTTACCCAAATAAAACTCATCCCAATTACATCTCAATC ATTAATGAAGACGGAAATGAGATCTTCAACACATCCTTATTTGAACCCCCTCCTCCAGGCTATGA AAATGTGTCGGATATTGTGCCACCTTTCAGCGCTTTCTCTCCCAAGGAATGCCCGAGGGCGACC TAGTGTATGTGAACTATGCACGGACTGAAGACTTTTTTAAATTGGAGCGGGACATGAAGATCAAT TGCTCCGGGAAAATTGTGATTGCCAGATACGGGAAGTTTTTAGAGGAAATAAAGTTAAAAATGC TCAGCTGGCAGGCGCCAAAGGAGTGATTCTCTACTCTGACCCTGCTGATTACTTTGCTCCCGGG TGAAGTCATATCCAGATGGCTGGAATCTTCCCGGAGGTGGTGTGCAGCGTGGAAACATCCTAAAT CTCAATGGTGCAGGCGACCCTCTCACCCCAGGTTACCCCGCAAATGAATACGCTTATAGGCGGG AATTGCAGAAGCTGTTGGTCTGCCAAGTATTCCAGTTCATCCAATCGGATACTATGACGCACAGA AGCTGCTAGAAAAGATGGGTGGCTCCGCACCACCAGACAGCAGCTGGAGGGGAAGTCTCAAGGTG CCCTACAACGTTGGACCTGGATTTACTGGAAATTTTTCTACACAGAAAGTCAAATGCACATCCA TTCTACCAATGAGGTGACAAGAATCTACAATGTGATCGGTACTCTCAGGGGAGCAGTGGAGCCAG ACAGGTATGTCATTCTCGGAGGTCACCGCGACTCATGGGTCTTTGGTGGTATCGACCCTCAGAGC GGAGCAGCTGTGGTTCATGAAATCGTGAGGAGCTTCGGAACACTGAAGAAGGAAGGCTGGAGACC TAGGAGAACAATCTTGTTTGCAAGTTGGGATGCAGAGGAATTTGGTCTGCTTGGTTCTACCGAGT GGGCAGAAGAGAACTCAAGACTCCTGCAAGAGCGTGGAGTGGCTTATATCAATGCTGACTCCTCT ATAGAAGGCAACTACACCCTGAGAGTTGACTGTACACCCCTGATGTACAGTTTGGTACACAATCT |

| SEQ ID NO. | DESIGNATION | SOURCE | TYPE | SEQUENCE |
|---|---|---|---|---|
| | | | | AACAAAAGAACTGAAAAGCCCCGATGAAGGCTTCGAAGGCAAATCCCTTTATGAAAGCTGGACTA<br>AAAAGAGTCCTTCCCCTGAGTTCAGTGGAATGCCCAGGATCAGCAAATTGGGCTCTGGAAATGAC<br>TTTGAGGTGTTTTTCCAACGACTGGGAATTGCTTCCGGCAGAGCACGCTATACTAAAAACTGGGA<br>AACAAATAAATTCAGTGGCTATCCCCTGTATCACAGCGTCTATGAAACCTATGAGTTGGTCGAAA<br>AGTTTTACGATCCAATGTTCAAATATCACCTGACTGTGGCTCAGGTTCGAGGCGGGATGGTGTTC<br>GAGCTCGCCAACTCCATAGTGCTGCCTTTTGATTGCCAAAGTTATGCTGTAGCTCTGAAGAAACA<br>TGCTGAGACTATCTACAACATTTCAATGAATCATCCACAGGAGATGAAGACATATAGTGTAAGCT<br>TCGATTCACTTTTCTCTGCAGTGAAGAATTTTACCGAAATTGCTTCTAAGTTTAGTGAGAGGCTC<br>CAGGACTTCGACAAAAGCAATCCAATAGTATTGAGAATGATGAACGATCAACTGATGTTTCTGGA<br>GAGAGCATTTATCGATCCATTAGGCTTACCAGACCGCCCTTTTTATAGACATGTCATCTACGCTC<br>AAGCAGTCACAACAAGTACGCAGGGGAGTCCTTCCCAGGAATCTATGACGCGTTGTTTGACATT<br>GAAAGCAAGGTGGACCCTTCTAAGGCCTGGGGCGAAGTGAAGAGGCAGATTTATGTGGCAGCCTT<br>CACCGTGCAGGCAGCCGCAGAGACCTTGAGTGAGGTAGCCTCCGGGGATTACAAGGACGACGATG<br>ACAAGTAA |
| 468. | huPSMArat598-<br>617 | artificial | aa | MWNLLHETDSAVATARRPRWLCAGALVLAGGFFLLGFLFGWFIKSSNEATNITPKHNMKAFLDEL<br>KAENIKKFLYNFTQIPHLAGTEQNFQLAKQIQSQWKEFGLDSVELAHYDVLLSYPNKTHPNYISI<br>INEDGNEIFNTSLFEPPPPGYENVSDIVPPFSAFSPQGMPEGDLVYVNYARTEDFFKLERDMKIN<br>CSGKIVIARYGKVFRGNKVKNAQLAGAKGVILYSDPADYFAPGVKSYPDGWNLPGGGVQRGNILN<br>LNGAGDPLTPGYPANEYAYRRGIAEAVGLPSIPVHPIGYYDAQKLLEKMGGSAPPDSSWRGSLKV<br>PYNVGPGFTGNFSTQKVKMHIHSTNEVTRIYNVIGTLRGAVEPDRYVILGGHRDSWVFGGIDPQS<br>GAAVVHEIVRSFGTLKKEGWRPRRTILFASWDAEEFGLLGSTEWAEENSRLLQERGVAYINADSS<br>IEGNYTLRVDCTPLMYSLVHNLTKELKSPDEGFEGKSLYESWTKKSPSPEFSGMPRISKLGSGND<br>FEVFFQRLGIASGRARYTKNWETNKFSGYPLYHSVYETYELVEKFYDPMFKYHLTVAQVRGGMVF<br>ELANSIVLPFDCQSYAVALKKHAETIYNISMNHPQEMKTYSVSFDSLFSAVKNFTEIASKFSERL<br>QDFDKSNPIVLRMMNDQLMFLERAFIDPLGLPDRPFYRHVIYAPSSHNKYAGESFPGIYDALFDI<br>ESKVDPSKAWGEVKRQIYVAAFTVQAAAETLSEVASGDYKDDDDK |
| 469. | huPSMArat683-<br>690 | artificial | nt | ATGTGGAATCTGCTTCACGAAACAGACTCGGCTGTCGCCACCGCGCGGCGCCCGCGGTGGCTGTG<br>CGCCGGGGCGCTGGTCCTGGCGGGTGGATTCTTTCTCCTGGGCTTCCTCTTTGGGTGGTTTATCA<br>AATCCTCCAACGAAGCTACTAATATTACTCCAAAACATAATATGAAGGCATTTTTGGACGAATTG<br>AAAGCCGAGAACATCAAAAAGTTCTTATACAATTTTACCCAGATACCACACTTAGCAGGAACCGA<br>ACAAAACTTCCAGCTTGCAAAACAAATTCAATCTCAGTGGAAAGAGTTTGGCCTGGACTCTGTTG<br>AGCTGGCACATTATGACGTCCTGTTGTCTTACCCAAATAAAACTCATCCCAATTACATCTCAATC<br>ATTAATGAAGACGGGAATGAGATCTTCAACACATCCTTATTTGAACCCCCTCCTCCAGGCTATGA<br>AAATGTGTCGGATATTGTGCCACCTTTCAGCGCTTTCTCTCCCAAGGAATGCCCGAGGGCGACC<br>TAGTGTATGTGAACTATGCACGGACTGAAGACTTTTTTAAATTGGAGCGGGACATGAAGATCAAT<br>TGCTCCGGGAAAATTGTGATTGCCAGATACGGGAAAGTTTTTAGAGGGAAATAAAGTTAAAAATGC<br>TCAGCTGGCAGGCGCCAAAGGAGTGATTCTCTACTCTGACCCTGCTGATTACTTTGCTCCCGGGG<br>TGAAGTCATATCCAGATGGCTGGAATCTTCCCGGAGGTGGTGTGCAGCGTGGAAACATCCTAAAT<br>CTCAATGGTGCAGGCGACCCTCTCACCCCAGGTTACCCCGCAAATGAATACGCTTATAGGCGGGG<br>AATTGCAGAAGCTGTTGGTCTGCCAAGTATTCCAGTTCATCCAATCGGATACTATGACGCACAGA<br>AGCTGCTAGAAAAGATGGGTGGCTCCGCACCACCAGACAGCAGCTGGAGGGGAAGTCTCAAGGTG<br>CCCTACAACGTTGGACCTGGATTTACTGGAAATTTTTCTACACAGAAAGTCAAAATGCACATCCA<br>TTCTACCAATGAGGTGACAAGAATCTACAATGTGATCGGTACTCTCAGGGGAGCAGTGGAGCCAG<br>ACAGGTATGTCATTCTCGGAGGTCACCGCGACTCATGGGTCTTTGGTGGTATCGACCCTCAGAGC<br>GGAGCAGCTGTGGTTCATGAAATCGTGAGGAGCTTCGGAACACTGAAGAAGGAAGGCTGGAGCGT<br>TAGGAGAACAATCTTGTTTGCAAGTTGGGATGCAGAGGAATTTGGTCTGCTTGGTTCTACCGAGT<br>GGGCAGAAGAGAACTCAAGACTCCTGCAAGAGCGTGGAGTGGCTTATATCAATGCTGACTCCTCT<br>ATAGAAGGCAACTACACCCTGAGAGTTGACTGTACACCCCTGATGTACAGTTTGGTACACAATCT<br>AACAAAAGAACTGAAAAGCCCCGATGAAGGCTTCGAAGGCAAATCCCTTTATGAAAGCTGGACTA<br>AAAAGAGTCCTTCCCCTGAGTTCAGTGGAATGCCCAGGATCAGCAAATTGGGCTCTGGAAATGAC<br>TTTGAGGTGTTTTTCCAACGACTGGGAATTGCTTCCGGCAGAGCACGCTATACTAAAAACTGGGA<br>AACAAATAAATTCAGTGGCTATCCCCTGTATCACAGCGTCTATGAAACCTATGAGTTGGTCGAAA<br>AGTTTTACGATCCAATGTTCAAATATCACCTGACTGTGGCTCAGGTTCGAGGCGGGATGGTGTTC<br>GAGCTCGCCAACTCCATAGTGCTGCCTTTTGATTGCCGAGATTATGCCGTAGTTTTAAGGAAGTA<br>TGCTGATAAAATCTACAGCATTTCTATGAAGCATCCACAGGAGATGAAGACATATAGTGTATCAT<br>TCGATTCACTTTTCTCTGCAGTGAAGAATTTTACCGAAATTGCTTCTAAGTTTAGTGAGAGGCTC<br>CAGGACTTCGACAAAAGCAATCCAATAGTATTGAGAATGATGAACGATCAACTGATGTTTCTGGA<br>GCGCGCATTTATCGATCCATTAGGCTTACCAGGAAGGCCTTTCTACAGGCATATCATCTACGCTC<br>AAGCAGTCACAACAAGTACGCAGGGGAGTCCTTCCCAGGAATCTATGACGCGTTGTTTGACATT<br>GAAAGCAAGGTGGACCCTTCTAAGGCCTGGGGCGAAGTGAAGAGGCAGATTTATGTGGCAGCCTT<br>CACCGTGCAGGCAGCCGCAGAGACCTTGAGTGAGGTAGCCTCCGGGGATTACAAGGACGACGATG<br>ACAAGTAA |
| 470. | huPSMArat683-<br>690 | artificial | aa | MWNLLHETDSAVATARRPRWLCAGALVLAGGFFLLGFLFGWFIKSSNEATNITPKHNMKAFLDEL<br>KAENIKKFLYNFTQIPHLAGTEQNFQLAKQIQSQWKEFGLDSVELAHYDVLLSYPNKTHPNYISI<br>INEDGNEIFNTSLFEPPPPGYENVSDIVPPFSAFSPQGMPEGDLVYVNYARTEDFFKLERDMKIN<br>CSGKIVIARYGKVFRGNKVKNAQLAGAKGVILYSDPADYFAPGVKSYPDGWNLPGGGVQRGNILN<br>LNGAGDPLTPGYPANEYAYRRGIAEAVGLPSIPVHPIGYYDAQKLLEKMGGSAPPDSSWRGSLKV<br>PYNVGPGFTGNFSTQKVKMHIHSTNEVTRIYNVIGTLRGAVEPDRYVILGGHRDSWVFGGIDPQS<br>GAAVVHEIVRSFGTLKKEGWRPRRTILFASWDAEEFGLLGSTEWAEENSRLLQERGVAYINADSS<br>IEGNYTLRVDCTPLMYSLVHNLTKELKSPDEGFEGKSLYESWTKKSPSPEFSGMPRISKLGSGND<br>FEVFFQRLGIASGRARYTKNWETNKFSGYPLYHSVYETYELVEKFYDPMFKYHLTVAQVRGGMVF<br>ELANSIVLPFDCRDYAVVLRKYADKIYSISMKHPQEMKTYSVSFDSLFSAVKNFTEIASKFSERL |

| SEQ ID NO. | DESIGNATION | SOURCE | TYPE | SEQUENCE |
|---|---|---|---|---|
| | | | | QDFDKSNPIVLRMMNDQLMFLERAFIDPLGLPGRPFYRHIIYAPSSHNKYAGESFPGIYDALFDI<br>ESKVDPSKAWGEVKRQIYVAAFTVQAAAETLSEVASGDYKDDDDK |
| 471. | huPSMArat716-<br>750 | artificial | nt | ATGTGGAATCTGCTTCACGAAACAGACTCGGCTGTCGCCACCGCGCGGCGCCCGCGGTGGCTGTG<br>CGCCGGGGCGCTGGTCCTGGCGGGTGGATTCTTTCTCCTGGGCTTCCTCTTTGGGTGGTTTATCA<br>AATCCTCCAACGAAGCTACTAATATTACTCCAAAACATAATATGAAGGCATTTTTGGACGAATTG<br>AAAGCCGAGAACATCAAAAAGTTCTTATACAATTTTACCCAGATACCACACTTAGCAGGAACCGA<br>ACAAAACTTCCAGCTTGCAAAACAAATTCAATCTCAGTGGAAAGAGTTTGGCCTGGACTCTGTTG<br>AGCTGGCACATTATGACGTCCTGTTGTCTTACCCAAATAAAACTCATCCCAATTACATCTCAATC<br>ATTAATGAAGACGGAAATGAGATCTTCAACACATCCTTATTTGAACCCCCTCCTCCAGGCTATGA<br>AAATGTGTCGGATATTGTGCCACCTTTCAGCGCTTTCTCTCCCAAGGAATGCCCGAGGGCGACC<br>TAGTGTATGTGAACTATGCACGGACTGAAGACTTTTTTAAATTGGAGCGGGACATGAAGATCAAT<br>TGCTCCGGGAAATTGTGATTGCCAGATACGGGAAGTTTTTAGAGGAAATAAAGTTAAAAATGC<br>TCAGCTGGCAGGCGCCAAAGGAGTGATTCTCTACTCTGACCCTGCTGATTACTTTGCTCCCGGGG<br>TGAAGTCATATCCAGATGGCTGGAATCTTCCCGGAGGTGGTGTGCAGCGTGGAAACATCCTAAAT<br>CTCAATGGTGCAGGCGACCCTCTCACCCCAGGTTACCCCGCAAATGAATACGCTTATAGGCGGGG<br>AATTGCAGAAGCTGTTGGTCTGCCAAGTATTCCAGTTCATCCAATCGGATACTATGACGCACAGA<br>AGCTGCTAGAAAAGATGGGTGGCTCCGCACCACCAGACAGCAGCTGGAGGGAAGTCTCAAGGTG<br>CCCTACAACGTTGGACCTGGATTTACTGGAAATTTTTCTACACAGAAAGTCAAAATGCACATCCA<br>TTCTACCAATGAGGTGACAAGAATCTACAATGTGATCGGTACTCTCAGGGGAGCAGTGGAGCCAG<br>ACAGGTATGTCATTCTCGGAGGTCACCGCGACTCATGGGTCTTTGGTGGATCGACCCTCAGAGC<br>GGAGCAGCTGTGGTTCATGAAATCGTGAGGAGCTTCGGAACACTGAAGAAGGAAGGCTGGAGACC<br>TAGGAGAACAATCTTGTTTGCAAGTTGGGATGCAGAGGAATTTGGTCTGCTTGGTTCTACCGAGT<br>GGGCAGAAGAGAACTCAAGACTCCTGCAAGAGCGTGGAGTGGCTTATATCAATGCTGACTCCTCT<br>ATAGAAGGCAACTACACCCTGAGAGTTGACTGTACACCCCTGATGTACAGTTTGGTACACAATCT<br>AACAAAGGAACTGAAAAGCCCCGATGAAGGCTTCGAAGGCAAATCCCTTTATGAAAGCTGGACTA<br>AAAAGAGTCCTTCCCCTGAGTTCAGTGGAATGCCCAGGATCAGCAAATTGGGCTCTGGAAATGAC<br>TTTGAGGTGTTTTTCCAACGACTGGGAATTGCTTCCGGCAGAGCACGCTATACTAAAAACTGGGA<br>AACAAATAAATTCAGTGGCTATCCCCTGTATCACAGCGTCTATGAAACCTATGAGTTGGTCGAAA<br>AGTTTTACGATCCAATGTTCAAATATCACCTGACTGTGGCTCAGGTTCGAGGCGGGATGGTGTTC<br>GAGCTCGCCAACTCCATAGTGCTGCCTTTTGATTGCCGAGATTATGCCGTAGTTTTAAGGAAGTA<br>TGCTGATAAAATCTACAGCATTTCTATGAAGCATCCACAGGAGATGAAGACATATAGTGTATCAT<br>TCGATTCACTTTTCTCTGCAGTGAAGAATTTTACCGAAATTGCTTCTAAGTTTAGTGAGAGGCTC<br>CAGGACTTCGACAAAAGCAATCCAATAGTATTGAGAATGATGAACGATCAACTGATGTTTCTGGA<br>GCGCGCATTTATCGATCCATTAGGCTTACCAGACCGCCCTTTTTATAGACATGTCATCTACGCTC<br>CAAGCAGTCACAACAAGTACGCAGGGGAGTCCTTCCCAGGAATCTATGACGCGTTGTTTGACATT<br>AATAACAAAGTCGATACTTCTAAGGCCTGGAGAGAAGTGAAAAGACAGATTTCTATTGCAGCCTT<br>TACAGTGCAAGCTGCAGCAGAGACTCTGAGAGAAGTAGACTCCGGGGATTACAAGGACGACGATG<br>ACAAGTAA |
| 472. | huPSMArat716-<br>750 | artificial | aa | MWNLLHETDSAVATARRPRWLCAGALVLAGGFFLLGFLFGWFIKSSNEATNITPKHNMKAFLDEL<br>KAENIKKFLYNFTQIPHLAGTEQNFQLAKQIQSQWKEFGLDSVELAHYDVLLSYPNKTHPNYISI<br>INEDGNEIFNTSLFEPPPPGYENVSDIVPPFSAFSPQGMPEGDLVYVNYARTEDFFKLERDMKIN<br>CSGKIVIARYGKVFRGNKVKNAQLAGAKGVILYSDPADYFAPGVKSYPDGWNLPGGGVQRGNILN<br>LNGAGDPLTPGYPANEYAYRRGIAEAVGLPSIPVHPIGYYDAQKLLEKMGGSAPPDSSWRGSLKV<br>PYNVGPGFTGNFSTQKVKMHIHSTNEVTRIYNVIGTLRGAVEPDRYVILGGHRDSWVFGGIDPQS<br>GAAVVHEIVRSFGTLKKEGWRPRRTILFASWDAEEFGLLGSTEWAEENSRLLQERGVAYINADSS<br>IEGNYTLRVDCTPLMYSLVHNLTKELKSPDEGFEGKSLYESWTKKSPSPEFSGMPRISKLGSGND<br>FEVFFQRLGIASGRARYTKNWETNKFSGYPLYHSVYETYELVEKFYDPMFKYHLTVAQVRGGMVF<br>ELANSIVLPFDCRDYAVVLRKYADKIYSISMKHPQEMKTYSVSFDSLFSAVKNFTEIASKFSERL<br>QDFDKSNPIVLRMMNDQLMFLERAFIDPLGLPDRPFYRHVIYAPSSHNKYAGESFPGIYDALFDI<br>NNKVDTSKAWREVKRQISIAAFTVQAAAETLREVDSGDYKDDDDK |
| 473. | PSMA-D4<br>HL x I2C HL | artificial | aa | QVQLVESGGGLVKPGESLRLSCAASGFTFSDYYMYWVRQAPGKGLEWVAIISDGGYYTYYSDIIK<br>GRFTISRDNAKNSLYLQMNSLKAEDTAVYYCARGEFPLLRHGAMDYWGQGTLVTVSSGGGGSGGGG<br>SGGGGSDIQMTQSPSSLSASVGDRVTITCKASQNVDTNVAWYQQKPGQAPKSLIYSASYRYSDVP<br>SRFSGSASGTDFTLTISSVQSEDFATYYCQQYDSYPYTFGGGTKLEIKSGGGGSEVQLVESGGGL<br>VQPGGSLKLSCAASGFTFNKYAMNWVRQAPGKGLEWVARIRSKYNNYATYYADSVKDRFTISRDD<br>SKNTAYLQMNNLKTEDTAVYYCVRHGNFGNSYISYWAYWGQGTLVTVSSGGGGSGGGGSGGGGSQ<br>TVVTQEPSLTVSPGGTVTLTCGSSTGAVTSGNYPNWVQQKPGQAPRGLIGGTKFLAPGTPARFSG<br>SLLGGKAALTLSGVQPEDEAEYYCVLWYSNRWVFGGGTKLTVL |
| 474. | PSMA-D4<br>HL x I2C HL | artificial | nt | CAGGTGCAGCTGGTCGAGTCTGGCGGCGGACTGGTGAAGCCTGGCGAGTCCCTGAGGCTGTCCTG<br>TGCCGCCTCCGGCTTCACCTTCTCCGACTACTACATGTACTGGGTCCGCCAGGCCCCTGGGAAGG<br>GGCTGGAATGGGTGGCCATCATCTCCGACGGCGGCTACTACACCTACTACTCCGACATCATCAAG<br>GGCCGGTTCACCATCTCCCGGGACAACGCCAAGAACAGCCTGTACCTGCAGATGAACTCCCTGAA<br>GGCCGAGGACACCGCCGTGTACTACTGCGCCCGGGGCTTCCCTCTGCTGAGACACGGCGCCATGG<br>ATTACTGGGGCCAGGGCACCCTGGTCACCGTCTCCTCAGGTGGTGGTGGTTCTGGCGGCGGCGGC<br>TCCGGTGGTGGTGGTTCTGACATCCAGATGACCCAGTCCCCCAGCTCCCTGTCCGCCTCCGTGGG<br>CGACAGAGTGACCATCACCTGCAAGGCCTCCCAGAACGTGGACACCAACGTGGCCTGGTATCAGC<br>AGAAGCCCGGCCAGGCCCCTAAGTCCCTGATCTACTCCGCCTCCTACCGGTACTCTGACGTGCCT<br>TCCCGGTTCTCCGGCTCCGCGTCCGGCACCGACTTCACCCTGACCATCTCCAGCGTGCAGTCTGA<br>GGACTTCGCCACGTACTACTGCCAGCAGTACGACTCCTACCCTTACACCTTCGGCGGAGGGACCA<br>AGCTGGAAATCAAGTCCGGAGGTGTGGATCCGAGGTGCAGCTGGTCGAGTCTGGAGGAGGATTG<br>GTGCAGCCTGGAGGGTCATTGAAACTCTCATGTGCAGCTCTGGATTCACCTTCAATAAGTACGC |

| SEQ ID NO. | DESIGNATION | SOURCE | TYPE | SEQUENCE |
|---|---|---|---|---|
| | | | | CATGAACTGGGTCCGCCAGGCTCCAGGAAAGGGTTTGGAATGGGTTGCTCGCATAAGAAGTAAAT<br>ATAATAATTATGCAACATATTATGCCGATTCAGTGAAAGACAGGTTCACCATCTCCAGAGATGAT<br>TCAAAAAACACTGCCTATCTACAAATGAACAACTTGAAAACTGAGGACACTGCCGTGTACTACTG<br>TGTGAGACATGGGAACTTCGGTAATAGCTACATATCCTACTGGGCTTACTGGGGCCAAGGGACTC<br>TGGTCACCGTCTCCTCAGGTGGTGGTGGTTCTGGCGGCGGCGGCTCCGGTGGTGGTGGTTCTCAG<br>ACTGTTGTGACTCAGGAACCTTCACTCACCGTATCACCTGGTGGAACAGTCACACTCACTTGTGG<br>CTCCCTGACTGGGGCTGTTACATCTGGCAACTACCCAAACTGGGTCCAACAAAAACCAGGTCAGG<br>CACCCCGTGGTCTAATAGGTGGGACTAAGTTCCTCGCCCCCGGTACTCCTGCCAGATTCTCAGGC<br>TCCCTGCTTGGAGGCAAGGCTGCCCTCACCCTCTCAGGGGTACAGCCAGAGGATGAGGCAGAATA<br>TTACTGTGTTCTATGGTACAGCAACCGCTGGGTGTTCGGTGGAGGAACCAAACTGACTGTCCTA |
| 475. | PSMA-P7-H | artificial | aa | EVQLLEQSGAELVKPGASVKLSCTASGFNIKDTYMDWVKQRPEQGLEWIARIDPANGDSKYDPKF<br>QGKATITADTSSNTAYLQLSSLTSEDTAVYYCARGGMIWYFDVWGQGTTVTVSS |
| 476. | PSMA-P7-HCDR1 | artificial | aa | DTYMD |
| 477. | PSMA-P7-HCDR2 | artificial | aa | RIDPANGDSKYDPKFQG |
| 478. | PSMA-P7-HCDR3 | artificial | aa | GGMIWYFDV |
| 479. | PSMA-P7-H | artificial | nt | GAGGTGCAGCTGCTCGAGCAGTCTGGGGCAGAGCTTGTGAAGCCAGGGGCCTCAGTCAAGTTGTC<br>CTGCACAGCTTCTGGCTTCAACATTAAAGACACCTATATGGACTGGGTGAAGCAGAGGCCTGAAC<br>AGGGCCTGGAATGGATTGCAAGGATTGATCCTGCGAATGGTGATAGTAAATATGACCCGAAATTC<br>CAGGGCAAGGCCACTATAACAGCAGACACATCCTCCAACACAGCCTACCTGCAGCTCAGCAGCCT<br>GACATCTGAGGACACTGCCGTCTATTATTGTGCTAGAGGCGGGATGATATGGTACTTCGATGTCT<br>GGGGCCAAGGGACCACGGTCACCGTCTCCTCA |
| 480. | PSMA-P7-L | artificial | aa | ELVLTQSPTTMAASPGEKITITCSASSSISSNYLHWYQQKPGFSPKLLIYRTSNLASGVPARFSG<br>SGSGTSYSLTIGTMEAEDVATYYCQQGSSLPYTFGGGTKLEIK |
| 481. | PSMA-P7-LCDR1 | artificial | aa | SASSSISSNYLH |
| 482. | PSMA-P7-LCDR2 | artificial | aa | RTSNLAS |
| 483. | PSMA-P7-LCDR3 | artificial | aa | QQGSSLPYT |
| 484. | PSMA-P7-L | artificial | nt | GAGCTCGTGCTCACCCAGTCTCCAACCACCATGGCTGCATCTCCCGGGGAGAAGATCACTATCAC<br>CTGCAGTGCCAGCTCAAGTATAAGTTCCAATTACTTGCATTGGTATCAGCAGAAGCCAGGATTCT<br>CCCCTAAACTCTTGATTTATAGGACATCCAATCTGGCTTCTGGAGTCCCAGCTCGCTTCAGTGGC<br>AGTGGGTCTGGGACCTCTTACTCTCTCACAATTGGCACCATGGAGGCTGAAGATGTTGCCACTTA<br>CTACTGCCAGCAGGGTAGTAGTTTACCGTACACGTTCGGAGGGGGGACCAAGCTTGAGATCAAA |
| 485. | PSMA-P7-HL | artificial | aa | EVQLLEQSGAELVKPGASVKLSCTASGFNIKDTYMDWVKQRPEQGLEWIARIDPANGDSKYDPKF<br>QGKATITADTSSNTAYLQLSSLTSEDTAVYYCARGGMIWYFDVWGQGTTVTVSSGGGGSGGGGSG<br>GGGSELVLTQSPTTMAASPGEKITITCSASSSISSNYLHWYQQKPGFSPKLLIYRTSNLASGVPA<br>RFSGSGSGTSYSLTIGTMEAEDVATYYCQQGSSLPYTFGGGTKLEIK |
| 486. | PSMA-P7-HL | artificial | nt | GAGGTGCAGCTGCTCGAGCAGTCTGGGGCAGAGCTTGTGAAGCCAGGGGCCTCAGTCAAGTTGTC<br>CTGCACAGCTTCTGGCTTCAACATTAAAGACACCTATATGGACTGGGTGAAGCAGAGGCCTGAAC<br>AGGGCCTGGAATGGATTGCAAGGATTGATCCTGCGAATGGTGATAGTAAATATGACCCGAAATTC<br>CAGGGCAAGGCCACTATAACAGCAGACACATCCTCCAACACAGCCTACCTGCAGCTCAGCAGCCT<br>GACATCTGAGGACACTGCCGTCTATTATTGTGCTAGAGGCGGGATGATATGGTACTTCGATGTCT<br>GGGGCCAAGGGACCACGGTCACCGTCTCCTCAGGTGGTGGTGGTTCTGGCGGCGGCGGCTCCGGT<br>GGTGGTGGTTCTGAGCTCGTGCTCACCCAGTCTCCAACCACCATGGCTGCATCTCCCGGGGAGAA<br>GATCACTATCACCTGCAGTGCCAGCTCAAGTATAAGTTCCAATTACTTGCATTGGTATCAGCAGA<br>AGCCAGGATTCTCCCCTAAACTCTTGATTTATAGGACATCCAATCTGGCTTCTGGAGTCCCAGCT<br>CGCTTCAGTGGCAGTGGGTCTGGGACCTCTTACTCTCTCACAATTGGCACCATGGAGGCTGAAGA<br>TGTTGCCACTTACTACTGCCAGCAGGGTAGTAGTTTACCGTACACGTTCGGAGGGGGGACCAAGC<br>TTGAGATCAAA |
| 487. | PSMA-P7 x I2C HL | artificial | aa | EVQLLEQSGAELVKPGASVKLSCTASGFNIKDTYMDWVKQRPEQGLEWIARIDPANGDSKYDPKF<br>QGKATITADTSSNTAYLQLSSLTSEDTAVYYCARGGMIWYFDVWGQGTTVTVSSGGGGSGGGGSG<br>GGGSELVLTQSPTTMAASPGEKITITCSASSSISSNYLHWYQQKPGFSPKLLIYRTSNLASGVPA<br>RFSGSGSGTSYSLTIGTMEAEDVATYYCQQGSSLPYTFGGGTKLEIKSGGGGSEVQLVESGGGLV<br>QPGGSLKLSCAASGFTFNKYAMNWVRQAPGKGLEWVARIRSKYNNYATYYADSVKDRFTISRDDS<br>KNTAYLQMNNLKTEDTAVYYCVRHGNFGNSYISYWAYWGQGTLVTVSSGGGGSGGGGSGGGGSQT<br>VVTQEPSLTVSPGGTVTLTCGSSTGAVTSGNYPNWVQQKPGQAPRGLIGGTKFLAPGTPARFSGS<br>LLGGKAALTLSGVQPEDEAEYYCVLWYSNRWVFGGGTKLTVL |
| 488. | PSMA-P7 x I2C HL | artificial | nt | GAGGTGCAGCTGCTCGAGCAGTCTGGGGCAGAGCTTGTGAAGCCAGGGGCCTCAGTCAAGTTGTC<br>CTGCACAGCTTCTGGCTTCAACATTAAAGACACCTATATGGACTGGGTGAAGCAGAGGCCTGAAC<br>AGGGCCTGGAATGGATTGCAAGGATTGATCCTGCGAATGGTGATAGTAAATATGACCCGAAATTC<br>CAGGGCAAGGCCACTATAACAGCAGACACATCCTCCAACACAGCCTACCTGCAGCTCAGCAGCCT<br>GACATCTGAGGACACTGCCGTCTATTATTGTGCTAGAGGCGGGATGATATGGTACTTCGATGTCT<br>GGGGCCAAGGGACCACGGTCACCGTCTCCTCAGGTGGTGGTGGTTCTGGCGGCGGCGGCTCCGGT |

| SEQ ID NO. | DESIGNATION | SOURCE | TYPE | SEQUENCE |
|---|---|---|---|---|
| | | | | GGTGGTGGTTCTGAGCTCGTGCTCACCCAGTCTCCAACCACCATGGCTGCATCTCCCGGGGAGAA
GATCACTATCACCTGCAGTGCCAGCTCAAGTATAAGTTCCAATTACTTGCATTGGTATCAGCAGA
AGCCAGGATTCTCCCCTAAACTCTTGATTTATAGGACATCCAATCGGCTTCTGGAGTCCCAGCT
CGCTTCAGTGGCAGTGGGTCTGGGACCTCTTACTCTCTCACAATTGGCACCATGGAGGCTGAAGA
TGTTGCCACTTACTACTGCCAGCAGGGTAGTAGTTTACCGTACACGTTCGGAGGGGGGACCAAGC
TTGAGATCAAATCCGGAGGTGGTGGATCCGAGGTGCAGCTGGTCGAGTCTGGAGGAGGATTGGTG
CAGCCTGGAGGGTCATTGAAACTCTCATGTGCAGCCTCTGGATTCACCTTCAATAAGTACGCCAT
GAACTGGGTCCGCCAGGCTCCAGGAAAGGGTTTGGAATGGGTTGCTCGCATAAGAAGTAAATATA
ATAATTATGCAACATATTATGCCGATTCAGTGAAAGACAGGTTCACCATCTCCAGAGATGATTCA
AAAAACACTGCCTATCTACAAATGAACAACTTGAAAACTGAGGACACTGCCGTGTACTACTGTGT
GAGACATGGGAACTTCGGTAATAGCTACATATCCTACTGGGCTTACTGGGGCCAAGGGACTCTGG
TCACCGTCTCCTCAGGTGGTGGTGGTTCTGGCGGCGGCGGCTCCGGTGGTGGTGGTTCTCAGACT
GTTGTGACTCAGGAACCTTCACTCACCGTATCACCTGGTGGAACAGTCACACTCACTTGTGGCTC
CTCGACTGGGGCTGTTACATCTGGCAACTACCCAAACTGGGTCCAACAAAAACCAGGTCAGGCAC
CCCGTGGTCTAATAGGTGGGACTAAGTTCCTCGCCCCCGGTACTCCTGCCAGATTCTCAGGCTCC
CTGCTTGGAGGCAAGGCTGCCCTCACCCTCTCAGGGGTACAGCCAGAGGATGAGGCAGAATATTA
CTGTGTTCTATGGTACAGCAACCGCTGGGTGTTCGGTGGAGGAACCAAACTGACTGTCCTA |
| 489. cMET-1 | artificial | nt | ATGGGATGGAGCTGTATCATCCTCTTCTTGGTAGCAACAGCTACAGGTGTACACTCCGAGTGTAA
AGAGGCACTAGCAAAGTCCGAGATGAATGTGAATATGAAGTATCAGCTTCCCAACTTCACCGCGG
AAACACCCATCCAGAATGTCATTCTACATGAGCATCACATTTTCCTTGGTGCCACTAACTACATT
TATGTTTTAAATGAGGAAGACCTTCAGAAGGTTGCTGAGTACAAGACTGGGCCTGTGCTGGAACA
CCCAGATTGTTTCCCATGTCAGGACTGCAGCAGCAAAGCCAATTTATCAGGAGGTGTTTGGAAAG
ATAACATCAACATGGCTCTAGTTGTGGACACCTACTATGATGATCAACTCATTAGCTGTGGCAGC
GTCAACAGAGGGACCTGCCAGCGACATGTCTTTCCCCACAATCATACTGCTGACATACAGTCGGA
GGTTCACTGCATATTCTCCCCACAGATAGAAGAGCCCAGCCAGTGTCCTGACTGTGTGGTGAGCG
CCCTGGGAGCCAAAGTCCTTTCATCTGTAAAGGACCGGTTCATCAACTTCTTTGTAGGCAATACC
ATAAATTCTTCTTATTTCCCAGATCATCCATTGCATTCGATATCAGTGAGAAGGCTAAAGGAAAC
GAAAGATGGTTTATGTTTTGACGGACCAGTCCTACATTGATGTTTTACCTGAGTTCAGAGATT
CTTACCCCATTAAGTATGTCCATGCCTTTGAAAGCAACAATTTTATTTACTTCTTGACGGTCCAA
AGGGAAACTCTAGATGCTCAGACTTTTCACACAAGAATAATCAGGTTCTGTTCCATAAACTCTGG
ATTGCATTCCTACATGGAAATGCCTCTGGAGTGTATTCTCACAGAAAAGAGAAAAAAGAGATCCA
CAAAGAAGGAAGTGTTTAATATACTTCAGGCTGCGTATGTCAGCAAGCCTGGGGCCCAGCTTGCT
AGACAAATAGGAGCCAGCCTGAATGATGACATTCTTTTCGGGGTGTTCGCACAAAGCAAGCCAGA
TTCTGCCGAACCAATGGATCGATCTGCCATGTGTGCATTCCCTATCAAATATGTCAACGACTTCT
TCAACAAGATCGTCAACAAAAACAATGTGAGATGTCTCCAGCATTTTTACGGACCCAATCATGAG
CACTGCTTTAATAGGACACTTCTGAGAAATTCATCAGGCTGTGAAGCGCGCCGTGATGAATATCG
AACAGAGTTTACCACAGCTTTGCAGCGCGTTGACTTATTCATGGGTCAATTCAGCGAAGTCCTCT
TAACTCTATATCCACCTTCATTAAAGGAGACCTCACCATAGCTAATCTTGGGACATCAGAGGGT
CGCTTCATGCAGGTTGTGGTTTCTCGATCAGGACCATCAACCCCTCATGTGAATTTTCTCCTGGA
CTCCCATCCAGTGTCTCCAGAAGTGATTGTGGAGCATACATTAAACCAAAATGGCTACACACTGG
TTATCACTGGGAAGAAGATCACGAAGATCCCATTGAATGGCTTGGGCTGCAGACATTTCCAGTCC
TGCAGTCAATGCCTCTCTGCCCCACCCTTTGTTCAGTGTGGCTGGTGCCACGACAAATGTGTGCG
ATCGGAGGAATGCCTGAGCGGGACATGGACTCAACAGATCTGTCTGCCTGCAATCTACAAGGTTT
TCCCAAATAGTGCACCCCTTGAAGGAGGGACAAGGCTGACCATATGTGGCTGGGACTTTGGATTT
CGGAGGAATAATAAATTTGATTTAAAGAAAACTAGAGTTCTCCTTGGAAATGAGAGCTGCACCTT
GACTTTAAGTGAGAGCACGATGAATACATTGAAATGCACAGTTGGTCCTGCCATGAATAAGCATT
TCAATATGTCCATAATTATTTCAAATGGCCACGGGACAACACAATACAGTACATTCTCCTATGTG
GATCCTGTAATAACAAGTATTTCGCCGAAATACGGTCCTATGGCTGGTGGCACTTTACTTACTTT
AACTGGAAATTACCTAAACAGTGGGAATAGCAGACACATTTCAATTGGTGGAAAAACATGTACTT
TAAAAAGTGTGTCAAACAGTATTCTTGAATGTTATACCCCAGCCCAAACCATTTCAACTGAGTTT
GCTGTTAAATTGAAAATTGACTTAGCCAACCGAGAGACAAGCATCTTCAGTTACCGTGAAGATCC
CATTGTCTATGAAATTCATCCAACCAAATCTTTTATTAGTGGTGGGAGCACAATAACAGGTGTTG
GGAAAAACCTGAACTCAGTTAGTGTCCCGAGAATGGTCATAAATGTGCATGAAGCAGGAAGGAAC
TTTACAGTGGCATGTCAACATCGCTCTAATTCAGAGATAATCTGTTGTACCACTCCTTCCCTGCA
ACAGCTGAATCTGCAACTCCCCCTGAAAACCAAAGCCTTTTTCATGTTAGATGGGATCCTTTCCA
AATACTTTGATCTCATTTATGTACATAATCCTGTGTTTAAGCCTTTTGAAAAGCCAGTGATGATC
TCAATGGGCAATGAAAATGTACTGGAAATTAAGGGAAATGATATTGACCCTGAAGCAGTTAAAGG
TGAAGTGTTAAAAGTTGGAAATAAGAGCTGTGAGAATATACACTTACATTCTGAAGCCGTTTTAT
GCACGGTCCCCAATGACCTGCTGAAATTGAACAGCGAGCTAAATATAGAGTGGAAGCAAGCAATT
TCTTCAACCGTCCTTGGAAAAGTAATAGTTCAACCAGATCAGAATTTCACATCCGGAGGTGGTGG
ATCCGGGCTGGTGTTATTGCTGTTATTGTGGTTGTGGTGATAGCAATTGTTGCTGGAATTGTTG
TGCTGGTTATTTCCAGAAAGAAGAGAATGGCAAAGTATGAGAAGGCTGAGATAAAGGAGATGGGT
GAGATGCATAGGGAACTCAATGCATAA |
| 490. cMET-2 | artificial | aa | MGWSCIILFLVATATGVHSECKEALAKSEMNVNMKYQLPNFTAETPIQNVILHEHHIFLGATNYI
YVLNEEDLQKVAEYKTGPVLEHPDCFPCQDCSSKANLSGGVWKDNINMALVVDTYYDDQLISCGS
VNRGTCQRHVFPHNHTADIQSEVHCIFSPQIEEPSQCPDCVVSALGAKVLSSVKDRFINFFVGNT
INSSYFPDHPLHSISVRRLKETKDGFMFLTDQSYIDVLPEFRDSYPIKYVHAFESNNFIYFLTVQ
RETLDAQTFHTRIIRFCSINSGLHSYMEMPLECILTEKRKKRSTKKEVFNILQAAYVSKPGAQLA
RQIGASLNDDILFGVFAQSKPDSAEPMDRSAMCAFPIKYVNDFFNKIVNKNNVRCLQHFYGPNHE
HCFNRTLLRNSSGCEARRDEYRTEFTTALQRVDLFMGQFSEVLLTSISTFIKGDLTIANLGTSEG
RFMQVVVSRSGPSTPHVNFLLDSHPVSPEVIVEHTLNQNGYTLVITGKKITKIPLNGLGCRHFQS
CSQCLSAPPFVQCGWCHDKCVRSEECLSGTWTQQICLPAIYKVFPNSAPLEGGTRLTICGWDFGF
RRNNKFDLKKTRVLLGNESCTLTLSESTMNTLKCTVGPAMNKHFNMSIIISNGHGTTQYSTFSYV |

-continued

| SEQ ID NO. | DESIGNATION | SOURCE | TYPE | SEQUENCE |
|---|---|---|---|---|
| | | | | DPVITSISPKYGPMAGGTLLTLTGNYLNSGNSRHISIGGKTCTLKSVSNSILECYTPAQTISTEF<br>AVKLKIDLANRETSIFSYREDPIVYEIHPTKSFISGGSTITGVGKNLNSVSVPRMVINVHEAGRN<br>FTVACQHRSNSEIICCTTPSLQQLNLQLPLKTKAFFMLDGILSKYFDLIYVHNPVFKPFEKPVMI<br>SMGNENVLEIKGNDIDPEAVKGEVLKVGNKSCENIHLHSEAVLCTVPNDLLKLNSELNIEWKQAI<br>SSTVLGKVIVQPDQNFTSGGGGSGAGVIAVIVVVVIAIVAGIVVLVISRKKRMAKYEKAEIKEMG<br>EMHRELNA |
| 491. | cMET-3 | artificial | nt | ATGGGATGGAGCTGTATCATCCTCTTCTTGGTAGCAACAGCTACAGGTGTACACTCCGAGTGTAA<br>AGAGGCACTAGCAAAGTCCGAGATGAATGTGAATATGAAGTATCAGCTTCCCAACTTCACCGCGG<br>AAACAGCCATCCAGAATGTCATTCTACATGAGCATCACATTTTCCTCGGTGCCACCAACTACATT<br>TATGTTTTAAATGAGGAAGACCTTCAGAAGGTTGCTGAGTACAAGACCGGGCCTGTGCTGGAACA<br>CCCAGATTGTTTCCCGTGTCAGGACTGCAGCAGCAAAGCCAATTTATCAGGAGGCGTTTGGAAAG<br>ATAACATCAACATGGCTCTGGTTGTGGACACCTACTATGATGATCAACTCATTAGCTGTGGCAGC<br>GTCAACAGAGGGACCTGCCAGCGACATGTCTTTCCCCATAATCATACTGCTGACATACAGTCGGA<br>GGTTCACTGCATATTCTCCCCACAGATAGAAGAGCCCAACCAGTGCCCTGACTGTGTGGTGAGCG<br>CCCTGGGAGCCAAAGTCCTTTCATCTGTAAAGGACCGGTTCATCAACTTCTTTGTAGGCAATACC<br>ATAAATTCTTCTTATTTCCCACATCATCCGTTGCATTCGATATCAGTGAGAAGGCTAAAGGAAAC<br>GAAAGATGGTTTTATGTTTTGACAGACCAGTCCTACATTGATGTTTTACCTGAGTTCAGAGATT<br>CTTACCCCATTAAGTACATCCACGCTTTTGAAAGCAACAATTTTACTTACTTCTTGACGGTCCAA<br>AGGGGAAACTCTAAATGCTCAGACTTTTCACACAAGAATAATCAGGTTCTGTTCCTTAAACTCTGG<br>ATTGCACTCCTACATGGAAATGCCTCTAGAGTGTATTCTCACAGAAAAGAGAAAAAAGAGATCCA<br>CAAAGAAGGAAGTGTTTAATATCCTTCAGGCTGCATATGTCAGCAGGCCCCAGCTTGCT<br>AGACAAATAGGAGCCAGCCTGAATGATGACATTCTCTTTGGGGTGTTCGCACAAAGCAAGCCAGA<br>TTCTGCCGAACCAATGGATCGATCTGCAATGTGTGCATTTCCTATCAAATATGTCAACGACTTCT<br>TCAACAAGATCGTCAACAAAAACAATGTGAGATGTCTCCAGCATTTTTATGGACCCAATCATGAG<br>CACTGTTTTAATAGGACACTTCTGAGAAATTCATCAGGCTGTGAAGCGCGCCGTGATGAATATCG<br>AGCAGAGTTTACCACAGCTTTGCAGCGGGTTGACTTATTCATGGGTCAATTCAGCGAAGTCCTCT<br>TAACATCTATATCCACCTTCGTGAAAGGAGACCTCACCATCGCTAATCTTGGGACATCAGAGGGT<br>CGCTTCATGCAGGTTGTGGTTTCTCGATCAGGACCATCAACCCCTCATGTGAATTTCTCCTGGA<br>CTCTCACCCGGTGTCTCCAGAAGTGATTGTGGAGCATCCATTAAACCAGAATGGCTACACACTGG<br>TTGTCACGGGGAAGAAGATCACCAAGATCCCATTGAATGGCTTGGGCTGCAGACATTTCCAGTCC<br>TGCAGTCAGTGCCTCTCTGCCCCACCCTTTGTGCAGTGTGGCTGGTGCCACGACAAATGTGTGCG<br>ATCGGAGGAATGCCCCAGTGGGACATGGACTCAACAGATCTGTCTGCCTGCAATCTACAAGGTTT<br>TCCCAACTAGTGCACCCCTTGAAGGAGGGACAAGGCTGACCATATGTGGCTGGGACTTTGGATTT<br>CGGAGGAATAATAAATTTGATTTAAAGAAAACTAGAGTTCTTCCTTGGAAATGAGAGCTGCACCTT<br>GACTTTAAGTGAGAGCACGATGAATACATTGAAATGCACAGTTGGTCCTGCCATGAATAAACATT<br>TCAATATGTCCATAATTATTTCAAATGGCCACGGGACAACACAATACAGTACATTTTCCTATGTG<br>GATCCTATAATAACAAGTATTTCGCCAAAATATGGCCCTATGGCTGGTGGCACTTTACTTACTTT<br>AACTGGAAATTACCTAAACAGTGGCAATTCTAGACACATTTCAATTGGTGGAAAAACATGTACTT<br>TAAAAGTGTGTCAAACAGTATTCTCGAATGTTATACCCCAGCCCAAACCATTTCAACTGAGTTT<br>GCTGTTAAATTGAAAATTGACTTAGCCAACCGAGAGACAAGCATCTTCAGTTACCGGGAAGACCC<br>CATTGTCTATGAAATTCATCCAACCAAATCTTTTATTAGTGGTGGGAGCACAATAACAGGTGTTG<br>GGAAAAACCTGCATTCAGTTAGTGTCCCGAGGATGGTCATAAATGTCATGAAGCAGGAAGGAAC<br>TTTACAGTGGCATGTCAGCATCGCTCTAATTCAGAGATAATCTGCTGTACCACTCCTTCCCTGCA<br>ACAGCTGAATCTGCAACTCCCCCTGAAAACCAAAGCCTTTTTCATGTTAGATGGGATCCTTTCCA<br>AATACTTTGATCTCATTTATGTACATAATCCTGTGTTTAAGCCTTTTGAAAAGCCAGTAATGATC<br>TCAATGGGCAATGAAAATGTACTGGAAATTAAGGGGAAATGATATTGACCCTGAAGCAGTTAAAGG<br>TGAAGTGTTAAAAGTTGGAAATAAGAGCTGTGAGAATATACACTTACATTCTGAAGCCGTTTTAT<br>GCACGGTCCCCAATGACCTGCTGAAATTGAACAGCGAGCTAAATATAGAGTGGAAGCAAGCAATT<br>TCTTCAACCGTCCTTGGAAAAGTAATAGTTCAACCAGATCAGAATTTCACCTCCGGAGGTGGTGG<br>ATCCGGGGCTGGTGTTATTGCTGTTATTGTGGTTGTGGTGATAGCAATTGTTGCTGGAATTGTTG<br>TGCTGGTTATTTCCAGAAAGAAGAGAATGCAAAGTATGAGAAGGCTGAGATAAAGGAGATGGGT<br>GAGATGCATAGGGAACTCAATGCATAA |
| 492. | cMET-4 | artificial | aa | MGWSCIILFLVATATGVHSECKEALAKSEMNVNMKYQLPNFTAETAIQNVILHEHHIFLGATNYI<br>YVLNEEDLQKVAEYKTGPVLEHPDCFPCQDCSSKANLSGGVWKDNINMALVVDTYYDDQLISCGS<br>VNRGTCQRHVFPHNHTADIQSEVHCIFSPQIEEPNQCPDCVVSALGAKVLSSVKDRFINFFVGNT<br>INSSYFPHHPLHSISVRRLKETKDGFMFLTDQSYIDVLPEFRDSYPIKYIHAFESNNFIYFLTVQ<br>RETLNAQTFHTRIIRFCSLNSGLHSYMEMPLECILTEKRKKRSTKKEVFNILQAAYVSKPGAQLA<br>RQIGASLNDDILFGVFAQSKPDSAEPMDRSAMCAFPIKYVNDFFNKIVNKNNVRCLQHFYGPNHE<br>HCFNRTLLRNSSGCEARRDEYRAEFTTALQRVDLFMGQFSEVLLTSISTFVKGDLTIANLGTSEG<br>RFMQVVVSRSGPSTPHVNFLLDSHPVSPEVIVEHPLNQNGYTLVVTGKKITKIPLNGLGCRHFQS<br>CSQCLSAPPFVQCGWCHDKCVRSEECPSGTWTQQICLPAIYKVFPTSAPLEGGTRLTICGWDFGF<br>RRNNKFDLKKTRVLLGNESCTLTLSESTMNTLKCTVGPAMNKHFNMSIIISNGHGTTQYSTFSYV<br>DPIITSISPKYGPMAGGTLLTLTGNYLNSGNSRHISIGGKTCTLKSVSNSILECYTPAQTISTEF<br>AVKLKIDLANRETSIFSYREDPIVYEIHPTKSFISGGSTITGVGKNLNSVSVPRMVINVHEAGRN<br>FTVACQHRSNSEIICCTTPSLQQLNLQLPLKTKAFFMLDGILSKYFDLIYVHNPVFKPFEKPVMI<br>SMGNENVLEIKGNDIDPEAVKGEVLKVGNKSCENIHLHSEAVLCTVPNDLLKLNSELNIEWKQAI<br>SSTVLGKVIVQPDQNFTSGGGGSGAGVIAVIVVVVIAIVAGIVVLVISRKKRMAKYEKAEIKEMG<br>EMHRELNA |
| 493. | cMET-5 | artificial | nt | ATGGGATGGAGCTGTATCATCCTCTTCTTGGTAGCAACAGCTACAGGTGTACACTCCGATTACAA<br>GGACGACGATGACAAGGAGTGCAAGGAGGCCCTAGTGAAGTCTGAGATGAACGTGAACATGAAGT<br>ATCAGCTCCCCAACTTCACGGCAGAAACCCCCATCCAGAATGTCGTCCTACACGGCCATCATATT<br>TATCTCGGAGCCACAAACTACATTTATGTTTTAAATGACAAAGACCTTCAGAAGGTATCCGAGTT |

| SEQ ID NO. | DESIGNATION | SOURCE | TYPE | SEQUENCE |
|---|---|---|---|---|
| | | | | CAAGACCGGGCCCGTGTTGGAACACCCAGATTGTTTACCTTGTCGGGACTGCAGCAGCAAAGCCA<br>ATTCATCAGGAGGGGTTTGGAAAGACAACATCAACATGGCTCTGCTTGTTGACACATACTATGAT<br>GATCAACTCATTAGCTGTGGCAGTGTCAACAGAGGGACTTGCCAGCGGCATGTCCTTCCTCCTGA<br>CAATTCTGCTGACATCCAGTCTGAGGTCCACTGCATGTTCTCCCCAGAAGAGGAGTCAGGGCAGT<br>GTCCTGACTGTGTAGTGAGTGCCCTCGGAGCCAAAGTCCTTCCTGTCGGAAAAGGACCGGTTCATC<br>AATTTCTTTGTGGGGAATACGATCAATTCCTCCTATCCTCCTGGTTATTCACTGCATTCGATATC<br>GGTGAGACGGCTGAAGGAAACCCAAGATGGTTTTAAGTTTTTGACAGACCAGTCCTATATTGATG<br>TCTTACCAGAGTTCCAAGATTCCTACCCCATAAAGTACATACATGCCTTCGAAAGCAACCATTTT<br>ATTTACTTTCTGACTGTCCAAAAGGAAACTCTAGATGCTCAGACTTTTCATACAAGAATAATCAG<br>GTTCTGTTCCGTAGACTCTGGGTTGCACTCCTACATGGAAATGCCCCTGGAATGCATCCTGACAG<br>AAAAAAGAAGGAAGAGATCCACAAGGGAAGAAGTGTTTAATATCCTCCAAGCCGCGTATGTCAGT<br>AAACCAGGGGCCAATCTTGCTAAGCAAATAGGGAGCTAGCCCTTCTGATGACATTCTCTTCGGGGT<br>GTTTGCACAAAGCAAGCCAGATTCTGCTGAACCTGTGAATCGATCAGCAGTCTGTGCATTCCCCA<br>TCAAATATGTCAATGACTTCTTCAACAAGATTGTCAACAAAAACAACGTGAGATGTCTCCAGCAT<br>TTTTACGGACCCAACCATGAGCACTGTTTCAATAGGACCCTGCTGAGAAACTCTTCCGGCTGTGA<br>AGCGCGCAGTGACGAGTATCGGACAGAGTTTACCACGGCTTTGCAGCGCGTGGACTTATTCATGG<br>GCCGGCTTAACCAAGTGCTCCTGACATCCATCTCCACCTTCATCAAAGGTGACCTCACCATTGCT<br>AATCTAGGGACGTCAGAAGGTCGCTTCATGCAGGTGGTGCTCTCTCGAACAGCACACTCACTCC<br>TCATGTGAACTTCCTCCTGGACTCCCATCCTGTATCTCCAGAAGTTATTGTTGAGCATCCATCAA<br>ATCAAAATGGCTATACATTGGTTGTCACAGGAAAGAAGATCACCAAGATTCCATTGAATGGCCTG<br>GGCTGTGGACATTTCCAATCCTGCAGTCAGTGCCTCTCTGCCCCTTACTTTATACAGTGTGGCTG<br>GTGCCACAATCAATGTGTGCGTTTTGATGAATGCCCCAGCGGTACATGGACTCAAGAGATCTGTC<br>TGCCGGCGGTTTATAAGGTGTTCCCCACCAGCGCCCCCCTTGAAGGAGGAACAGTGTTGACCATA<br>TGTGGCTGGGACTTTGGATTCAGGAAGAATAATAAATTTGATTTAAGGAAAACCAAGTTCTGCT<br>TGGCAACGAGAGCTGTACCTTGACCTTAAGCGAGAGCACGACAAATACGTTGAAATGCACAGTTG<br>GTCCCGCGATGAGTGAGCACTTCAATGTGTCTGTAATTATCTCAAACAGTCGAGAGACGACGCAA<br>TACAGTGCATTCTCCTATGTAGATCCTGTAATAACAAGCATTTCTCCGAGGTACGGCCCTCAGGC<br>TGGAGGCACCTTACTCACTCTTACTGGGAAATACCTCAACAGTGGCAATTCTAGGCACATTTCAA<br>TTGGAGGGAAAACATGTACTTTAAAAAGTGTATCAGATAGTATTCTTGAATGCTACACCCCAGCC<br>CAAACTACCTCTGATGAGTTTCCTGTGAAATTGAAGATTGACTTGGCTAACCGAGAGACCAGCAG<br>CTTCAGTTACCGGGAAGACCCCGTTGTCTATGAAATCCACCCGACCAAATCTTTTATTAGTGGTG<br>GAAGCACAATAACGGGTATTGGGAAGACCCTGAACTCGGTTAGCCTCCCAAAGCTGGTAATAGAT<br>GTGCATGAAGTGGGTGTGAACTACACAGTGGCATGTCAGCATCGCTCAAATTCAGAGATCATCTG<br>CTGCACTACTCCTTCACTGAAACAGCTGGGCCTGCAACTCCCCCTGAAGACCAAAGCCTTCTTCC<br>TGTTAGACGGGATTCTTTCCAAACACTTTGATCTCACTTATGTGCATAATCCTGTGTTTGAGCCT<br>TTTGAAAAGCCAGTAATGATCTCAATAGGCAATGAAAATGTAGTGGAAATTAAGGGAAACAATAT<br>TGACCCTGAAGCAGTTAAAGGTGAAGTGTTAAAAGTTGGAAATCAGAGCTGCGAGAGTCTCCACT<br>GGCACTCTGGAGCTGTGTGTTGTGTACAGTCCCCAGTGACCTGCTCAAACTGAACAGCGAGCTAAT<br>ATAGAGTGGAAGCAAGCAGTCTCTTCAACTGTTCTTGGAAAAGTGATCGTTCAACCGGATCAGAA<br>TTTTGCATCCGGAGGTGGTGGATCCGGGGCTGGTGTTATTGCTGTTATTGTGGTTGTGGTGATAG<br>CAATTGTTGCTGGAATTGTTGTGCTGGTTATTTCCAGAAAGAAGAGAATGGCAAAGTATGAGAAG<br>GCTGAGATAAAGGAGATGGGTGAGATGCATAGGGAACTCAATGCATAA |
| 494. | cMET-6 | artificial | aa | MGWSCIILFLVATATGVHSDYKDDDDKECKEALVKSEMNVNMKYQLPNFTAETPIQNVVLHGHHI<br>YLGATNYIYVLNDKDLQKVSEFKTGPVLEHPDCLPCRDCSSKANSSGGVWKDNINMALLVDTYYD<br>DQLISCGSVNRGTCQRHVLPPDNSADIQSEVHCMFSPEEESGQCPDCVVSALGAKVLLSEKDRFI<br>NFFVGNTINSSYPPGYSLHSISVRRLKETQDGFKFLTDQSYIDVLPEFQDSYPIKYIHAFESNHF<br>IYFLTVQKETLDAQTFHTRIIRFCSVDSGLHSYMEMPLECILTEKRRKRSTREEVFNILQAAYVS<br>KPGANLAKQIGASPSDDILFGVFAQSKPDSAEPVNRSAVCAFPIKYVNDFFNKIVNKNNVRCLQH<br>FYGPNHEHCFNRTLLRNSSGCEARSDEYRTEFTTALQRVDLFMGRLNQVLLTSISTFIKGDLTIA<br>NLGTSEGRFMQVVLSRTAHLTPHVNFLLDSHPVSPEVIVEHPSNQNGYTLVVTGKKITKIPLNGL<br>GCGHFQSCSQCLSAPYFIQCGWCHNQCVRFDECPSGTWTQEICLPAVYKVFPTSAPLEGGTVLTI<br>CGWDFGFRKNNKFDLRKTKVLLGNESCTLTLSESTTNTLKCTVGPAMSEHFNVSVIISNSRETTQ<br>YSAFSYVDPVITSISPRYGPQAGGTLLTLTGKYLNSGNSRHISIGGKTCTLKSVSDSILECYTPA<br>QTTSDEFPVKLKIDLANRETSSFSYREDPVVYEIHPTKSFISGGSTITGIGKTLNSVSLPKLVID<br>VHEVGVNYTVACQHRSNSEIICCTTPSLKQLGLQLPLKTKAFFLLDGILSKHFDLTYVHNPVFEP<br>FEKPVMISIGNENVVEIKGNNIDPEAVKGEVLKVGNQSCESLHWHSGAVLCTVPSDLLKLNSELN<br>IEWKQAVSSTVLGKVIVQPDQNFASGGGSGAGVIAVIVVVIAIVAGIVVLVISRKKRMAKYEK<br>AEIKEMGEMHRELNA |
| 495. | cMET-7 | artificial | nt | ATGGGATGGAGCTGTATCATCCTCTTCTTGGTAGCAACAGCTACAGGTGTACACTCCGATTACAA<br>GGACGACGATGACAAGGAGTGTAAAGAGGCACTAGCAAAGTCCGAGATGAATGTGAATATGAAGT<br>ATCAGCTTCCCAACTTCACCGCGGAAACACCCATCCAGAATGTCATTCTACATGAGCATCACATT<br>TTCCTTGGTGCCACTAACTACATTTATGTTTTAAATGAGGAGACCTTCAGAAGGTTGCTGAGTA<br>CAAGACTGGGCCTGTGCTGGAACACCCAGATTGTTTCCCATGTCAGGACTGCAGCAGCAAAGCCA<br>ATTTATCAGGAGGTGTTTGGAAAGATAACATCAACATGGCTCTAGTTGTGGACACCTACTATGAT<br>GATCAACTCATTAGCTGTGGCAGCGTCAACAGAGGGACCTGCCAGCGACATGTCTTCCCCACAA<br>TCATACTGCTGACATACAGTCGGAGGTTCACTGCATATTCTCCCCACAGATAGAAGAGCCCAGCC<br>AGTGTCCTGACTGTGTGGTGAGCGCCCTGGGAGCCAAAGTCCTTTCATCTGTAAAGGACCGGTTC<br>ATCAACTTCTTTGTAGGCAATACCATAAATTCTTCTTATTTCCCGATCATCCATTGCATTCGAT<br>ATCAGTGAAGGCTAAAGGAAACGAAAGATGGTTTATGTTTTTGACGGACCAGTCCTACATTG<br>ATGTTTTACCTGAGTTCAGAGATTCTTACCCCATTAAGTATGTCCATGCCTTTGAAAGCAACAAT<br>TTTATTTACTTCTTGACGGTTCCAAAGGGAAACTCTAGATGCTCAGACTTTTCACACAAGAATAAT<br>CAGGTTCTGTTCCATAAACTCTGGATTGCATTCCTACATGGAAATGCCTCTGGAGTGTATTCTCA<br>CAGAAAAGAGAAAAAGAGATCCACAAGGGAAGAAGTGTTTAATATCCTCCAAGCCGCGTATGTC |

-continued

| SEQ ID NO. | DESIGNATION | SOURCE | TYPE | SEQUENCE |
|---|---|---|---|---|
| | | | | AGTAAACCAGGGGCCAATCTTGCTAAGCAAATAGGAGCTAGCCCTTCTGATGACATTCTCTTCGG |
| | | | | GGTGTTTGCACAAAGCAAGCCAGATTCTGCTGAACCTGTGAATCGATCAGCAGTCTGTGCATTCC |
| | | | | CCATCAAATATGTCAATGACTTCTTCAACAAGATTGTCAACAAAAACAACGTGAGATGTCTCCAG |
| | | | | CATTTTTACGGACCCAACCATGAGCACTGTTTCAATAGGACCCTGCTGAGAAACTCTTCCGGCTG |
| | | | | TGAAGCGCGCAGTGACGAGTATCGGACAGAGTTTACCACGGCTTTGCAGCGCGTGGACTTATTCA |
| | | | | TGGGCCGGCTTAACCAAGTGCTCCTGACATCCATCTCCACCTTCATCAAAGGTGACCTCACCATT |
| | | | | GCTAATCTAGGGACGTCAGAAGGTCGCTTCATGCAGGTGGTGCTCTCTCGAACAGCACACCTCAC |
| | | | | TCCTCATGTGAACTTCCTCCTGGACTCCCATCCTGTATCTCCAGAAGTTATTGTTGAGCATCCAT |
| | | | | CAAATCAAAATGGCTATACATTGGTTGTCACAGGAAAGAAGATCACCAAGATTCCATTGAATGGC |
| | | | | CTGGGCTGTGGACATTTCCAATCCTGCAGTCAGTGCCTCTCTGCCCCTTACTTTATACAGTGTGG |
| | | | | CTGGTGCCACAATCAATGTGTGCGTTTTGATGAATGCCCCAGCGGTACATGGACTCAAGAGATCT |
| | | | | GTCTGCCGGCGGTTTATAAGGTGTTCCCCACCAGCGCCCCCCTTGAAGGAGGAACAGTGTTGACC |
| | | | | ATATGTGGCTGGGACTTTGGATTCAGGAAGAATAATAAATTTGATTTAAGGAAAACCAAAGTTCT |
| | | | | GCTTGGCAACAGAGCTGTACCTTGACCTTAAGCGAGAGCACGACAAATACGTTGAAATGCACAG |
| | | | | TTGGTCCCGCGATGAGTGAGCACTTCAATGTGTCTGTAATTATCTCAAACAGTCGAGAGACGACG |
| | | | | CAATACAGTGCATTCTCCTATGTAGATCCTGTAATAACAAGCATTTCTCCGAGGTACGGCCCTCA |
| | | | | GGCTGGAGGCACCTTACTCACTCTTACTGGGAAATACCTCAACAGTGGCAATTCTAGGCACATTT |
| | | | | CAATTGGAGGGAAAACATGTACTTTTAAAAAGTGTATCAGATAGTATTCTTGAATGCTACACCCA |
| | | | | GCCCAAACTACCTCTGATGAGTTTCCTGTGAAATTGAAGATTGACTTGGCTAACCGAGAGACCAG |
| | | | | CAGCTTCAGTTACCGGGAAGACCCCGTTGTCTATGAAATCCACCCGACCAAATCTTTTATTAGTG |
| | | | | GTGGAAGCACAATAACGGGTATTGGGAAGACCCTGAACTCGGTTAGCCTCCCAAAGCTGGTAATA |
| | | | | GATGTGCATGAAGTGGGTGTGAACTACACAGTGGCATGTCAGCATCGCTCAAATTCAGAGATCAT |
| | | | | CTGCTGCACTACTCCTTCACTGAAACAGCTGGGCCTGCAACTCCCCCTGAAGACCAAAGCCTTCT |
| | | | | TCCTGTTAGACGGGATTCTTTCCAAACACTTTGATCTCACTTATGTGCATAATCCTGTGTTTGAG |
| | | | | CCTTTTGAAAAGCCAGTAATGATCTCAATAGGCAATGAAAATGTAGTGGAAATTAAGGGAAACAA |
| | | | | TATTGACCCTGAAGCAGTTAAAGGTGAAGTGTTAAAAGTTGGAAATCAGAGCTGCGAGAGTCTCC |
| | | | | ACTGGCACTCTGGAGCTGTGTTGTGTACAGTCCCCAGTGACCTGCTCAAACTGAACAGCGAGCTA |
| | | | | AATATAGAGTGGAAGCAAGCAGTCTCTTCAACTGTTCTTGGAAAAGTGATCGTTCAACCGGATCA |
| | | | | GAATTTTGCATCCGGAGGTGGTGGATCCGGGGCTGGTGTTATTGCTGTTATTGTGGTTGTGGTGA |
| | | | | TAGCAATTGTTGCTGGAATTGTTGTGCTGGTTATTTCCAGAAAGAAGAGAATGGCAAAGTATGAG |
| | | | | AAGGCTGAGATAAAGGAGATGGGTGAGATGCATAGGGAACTCAATGCATAA |
| 496. | cMET-8 | artificial | aa | MGWSCIILFLVATATGVHSDYKDDDDKECKEALAKSEMNVMKYQLPNFTAETPIQNVILHEHHI |
| | | | | FLGATNYIYVLNEEDLQKVAEYKTGPVLEHPDCFPCQDCSSKANLSGGVWKDNINMALVVDTYYD |
| | | | | DQLISCGSVNRGTCQRHVFPHNHTADIQSEVHCIFSPQIEEPSQCPDCVVSALGAKVLSSVKDRF |
| | | | | INFFVGNTINSSYFPDHPLHSISVRRLKETKDGFMFLTDQSYIDVLPEFRDSYPIKYVHAFESNN |
| | | | | FIYFLTVQRETLDAQTFHTRIIRFCSINSGLHSYMEMPLECILTEKRKKRSTREEVFNILQAAYV |
| | | | | SKPGANLAKQIGASPSDDILFGVFAQSKPDSAEPVNRSAVCAFPIKYVNDFFNKIVNKNNVRCLQ |
| | | | | HFYGPNHEHCFNRTLLRNSSGCEARSDEYRTEFTTALQRVDLFMGRLNQVLLTSISTFIKGDLTI |
| | | | | ANLGTSEGRFMQVVLSRTAHLTPHVNFLLDSHPVSPEVIVEHPSNQNGYTLVVTGKKITKIPLNG |
| | | | | LGCGHFQSCSQCLSAPYFIQCGWCHNQCVRFDECPSGTWTQEICLPAVYKVFPTSAPLEGGTVLT |
| | | | | ICGWDFGFRKNNKFDLRKTKVLLGNESCTLTLSESTTNTLKCTVGPAMSEHFNVSVIISNSRETT |
| | | | | QYSAFSYVDPVITSISPRYGPQAGGTLLTLTGKYLNSGNSRHISIGGKTCTLKSVSDSILECYTP |
| | | | | AQTTSDEFPVKLKIDLANRETSSFSYREDPVVYEIHPTKSFISGGSTITGIGKTLNSVSLPKLVI |
| | | | | DVHEVGVNYTVACQHRSNSEIICCTTPSLKQLGLQLPLKTKAFFLLDGILSKHFDLTYVHNPVFE |
| | | | | PFEKPVMISIGNENVVEIKGNNIDPEAVKGEVLKVGNQSCESLHWHSGAVLCTVPSDLLKLNSEL |
| | | | | NIEWKQAVSSTVLGKVIVQPDQNFASGGGGSGAGVIAVIVVVIAIVAGIVVLVISRKKRMAKYE |
| | | | | KAEIKEMGEMHRELNA |
| 497. | cMET-9 | artificial | nt | ATGGGATGGAGCTGTATCATCCTCTTCTTGGTAGCAACAGCTACAGGTGTACACTCCGATTACAA |
| | | | | GGACGACGATGACAAGGAGTGCAAGGAGGCCCTAGTGAAGTCTGAGATGAACGTGAACATGAAGT |
| | | | | ATCAGCTCCCCAACTTCACGGCAGAAACCCCCATCCAGAATGTCGTCCTACACGGCCATCATATT |
| | | | | TATCTCGGAGCCACAAACTACATTTATGTTTTAAATGACAAAGACCTTCAGAAGGTATCCGAGTT |
| | | | | CAAGACCGGGCCCGTGTTGGAACACCCAGATTGTTTACCTTGTCGGGACTGCAGCAGCAAAGCCA |
| | | | | ATTCATCAGGAGGGTTTGGAAAGACAACATCAACATGGCTCTGCTTGTTGACACATACTATGAT |
| | | | | GATCAACTCATTAGCTGTGGCAGTGTCAACAGAGGGACTTGCCAGCGGCATGTCCTTCCTCCTGA |
| | | | | CAATTCTGCTGACATCCAGTCTGAGGTCCACTGCATGTTCTCCCCAGAAGAGGAGTCAGGGCAGT |
| | | | | GTCCTGACTGTGTAGTGAGTGCCCTCGGAGCCAAAGTCCTCCTGTCGGAAAAGGACCGGTTCATC |
| | | | | AATTTCTTTGTGGGGAATACGATCAATTCCTCCTATCCTCCTGGTTATTCACTGCATTCGATATC |
| | | | | GGTGAGACGGCTGAAGGAAACCCAAGATGGTTTTAAGTTTTTGACAGACCAGTCCTATATTGATG |
| | | | | TCTTACCAGAGTTCCAAGATTCCTACCCCATAAAGTACATACATGCCTTCGAAAGCAACCATTTT |
| | | | | ATTTACTTTCTGACTGTCCAAAAGGAAACTCTAGATGCTCAGACTTTTCATACAAGAATAATCAG |
| | | | | GTTCTGTTCCGTAGACTCTGGGTTGCACTCCTACATGGAAATGCCCCTGGAATGCATCCTGACAG |
| | | | | AAAAAAGAAGGAAGAGATCCACAAAGAAGGAAGTGTTTAATACATTCAGGCTGCGTATGTCAGC |
| | | | | AAGCCTGGGGCCCAGCTTGCTAGACAAATAGGAGCCAGCCTGAATGATGACATTCTTTTCGGGGT |
| | | | | GTTCGCACAAAGCAAGCCAGATTCTGCCGAACCAATGGATCGATCTGCCATGTGTGCATTCCCTA |
| | | | | TCAAATATGTCAACGACTTCTTCAACAAGATCGTCAACAAAAACAATGTGAGATGTCTCCAGCAT |
| | | | | TTTTACGGACCCAATCATGAGCACTGCTTTAATAGGACACTTCTGAGAAATTCATCAGGCTGTGA |
| | | | | AGCGCGCCGTGATGAATATCGAACAGAGTTTACCACAGCTTTGCAGCGCGTTGACTTATTCATGG |
| | | | | GTCAATTCAGCGAAGTCCTCTTAACATCTATATCCACCTTCATTAAAGGAGACCTCACCATAGCT |
| | | | | AATCTTGGACATCAGAGGGTCGCTTCATGCAGGTTGTGGTTTCTCGATCAGGACCATCAACCCCC |
| | | | | TCATGTGAATTTTCTCCTGGACTCCCATCCAGTGTCTCCAGAAGTGATTGTGGAGCATACATTAA |
| | | | | ACCAAAATGGCTACACACTGGTTATCACTGGGAAGAAGATCACGAAGATCCCATTGAATGGCTTG |
| | | | | GGCTGCAGACATTTCCAGTCCTGCAGTCAATGCCTCTGCCCCACCCTTTGTTCAGTGTGGCTG |
| | | | | GTGCCACGACAAATGTGTGCGATCGGAGGAATGCCTGAGCGGGACATGGACTCAACAGATCTGTC |

| SEQ ID NO. | DESIGNATION | SOURCE | TYPE | SEQUENCE |
|---|---|---|---|---|
| | | | | TGCCTGCAATCTACAAGGTTTTCCCAAATAGTGCACCCCTTGAAGGAGGGACAAGGCTGACCATA<br>TGTGGCTGGGACTTTGGATTTCGGAGGAATAATAAATTTGATTTAAAGAAAACTAGAGTTCTCCT<br>TGGAAATGAGAGCTGCACCTTGACTTTAAGTGAGAGCACGATGAATACATTGAAATGCACAGTTG<br>GTCCTGCCATGAATAAGCATTTCAATATGTCCATAATTATTTCAAATGGCCACGGGACAACACAA<br>TACAGTACATTCTCCTATGTGGATCCTGTAATAACAAGTATTTCGCCGAAATACGGTCCTATGGC<br>TGGTGGCACTTTACTTACTTTAACTGGAAATTACCTAAACAGTGGGAATAGCAGACACATTTCAA<br>TTGGTGGAAAAACATGTACTTTAAAAGTGTGTCAAACAGTATTCTTGAATGTTATACCCCAGCC<br>CAAACCATTTCAACTGAGTTTGCTGTTAAATTGAAAATTGACTTAGCCAACCGAGAGACAAGCAT<br>CTTCAGTTACCGTGAAGATCCATTGTCTATGAAATTCATCCAACCAAATCTTTTATTAGTGGTG<br>GGAGCACAATAACAGGTGTTGGGAAAAACCTGAACTCAGTTAGTGTCCCGAGAATGGTCATAAAT<br>GTGCATGAAGCAGGAAGGAACTTTACAGTGGCATGTCAACATCGCTCTAATTCAGAGATAATCTG<br>TTGTACCACTCCTTCCCTGCAACAGCTGAATCTGCAACTCCCCCTGAAAACCAAAGCCTTTTTCA<br>TGTTAGATGGGATCCTTTCCAAATACTTTGATCTCATTTATGTACATAATCCTGTGTTTAAGCCT<br>TTTGAAAAGCCAGTGATGATCTCAATGGGCAATGAAAATGTACTGGAAATTAAGGGAAATGATAT<br>TGACCCTGAAGCAGTTAAAGGTGAAGTGTTAAAAGTTGGAAATAAGAGCTGTGAGAATATACACT<br>TACATTCTGAAGCCGTTTTATGCACGGTCCCCAATGACCTGCTGAAATTGAACAGCGAGCTAAAT<br>ATAGAGTGGAAGCAAGCAATTTCTTCAACCGTCCTTGGAAAAGTAATAGTTCAACCAGATCAGAA<br>TTTCACATCCGGAGGTGGTGGATCCGGGGCTGGTGTTATTGCTGTTATTGTGGTTGTGGTGATAG<br>CAATTGTTGCTGGAATTGTTGTGCTGGTTATTTCCAGAAAGAAGAGAATGGCAAAGTATGAGAAG<br>GCTGAGATAAAGGAGATGGGTGAGATGCATAGGGAACTCAATGCATAA |
| 498. | cMET-10 | artificial | aa | MGWSCIILFLVATATGVHSDYKDDDDKECKEALVKSEMNVNMKYQLPNFTAETPIQNVVLHGHHI<br>YLGATNYIYVLNDKDLQKVSEFKTGPVLEHPDCLPCRDCSSKANSSGGVWKDNINMALLVDTYYD<br>DQLISCGSVNRGTCQRHVLPPDNSADIQSEVHCMFSPEEESGQCPDCVVSALGAKVLLSEKDRFI<br>NFFVGNTINSSYPPGYSLHSISVRRLKETQDGFKFLTDQSYIDVLPEFQDSYPIKYIHAFESNHF<br>IYFLTVQKETLDAQTFHTRIIRFCSVDSGLHSYMEMPLECILTEKRRKRSTKKEVFNILQAAYVS<br>KPGAQLARQIGASLNDDILFGVFAQSKPDSAEPMDRSAMCFAPIKYVNDFFNKIVNKNNVRCLQH<br>FYGPNHEHCFNRTLLRNSSGCEARRDEYRTEFFTALQRVDLFMGQFSEVLLTSISTFIKGDLTIA<br>NLGTSEGRFMQVVVSRSGPSTPHVNFLLDSHPVSPEVIVEHTLNQNGYTLVITGKKITKIPLNGL<br>GCRHFQSCSQCLSAPPFVQCGWCHDKCVRSEECLSGTWTQQICLPAIYKVFPNSAPLEGGTRLTI<br>CGWDFGFRRNNKFDLKKTRVLLGNESCTLTLSESTMNTLKCTVGPAMNKHFNMSIISNGHGTTQ<br>YSTFSYVDPVITSISPKYGPMAGGTLLTLTGNYLNSGNSRHISIGGKTCTLKSVSNSILECYTPA<br>QTISTEFAVKLKIDLANRETSIFSYREDPIVYEIHPTKSFISGGSTITGVGKNLNSVSVPRMVIN<br>VHEAGRNFTVACQHRSNSEIICCTTPSLQQLNLQLPLKTKAFFMLDGILSKYFDLIYVHNPVFKP<br>FEKPVMISMGNENVLEIKGNDIDPEAVKGEVLKVGNKSCENIHLHSEAVLCTVPNDLLKLNSELN<br>IEWKQAISSTVLGKVIVQPDQNFTSGGGGSGAGVIAVIVVVIAIVAGIVVLVISRKKRMAKYEK<br>AEIKEMGEMHRELNA |
| 499. | ME86H11-H | artificial | aa | QVQLVQSGAEVKRPGASVKVSCRASGYTFTSYWLHWVRQGPGQRLEWIGMIDPSNSDTRFNPNFK<br>DRATFTVDTSASTAYMELSSLTSEDTAVYYCATYGSYVSPLDYWGQGTSVTVSS |
| 500. | ME86H11-HCDR1 | artificial | aa | SYWLH |
| 501. | ME86H11-HCDR2 | artificial | aa | MIDPSNSDTRFNPNFKD |
| 502. | ME86H11-HCDR3 | artificial | aa | YGSYVSPLDY |
| 503. | ME86H11-H | artificial | nt | CAGGTGCAGCTGGTCCAGTCTGGGGCTGAAGTGAAGAGGCCTGGGGCTTCAGTGAAAGTGTCCTG<br>CAGGGCTTCGGGCTATACCTTCACCAGCTACTGGTTGCACTGGGTTAGACAGGGGCCTGGACAAA<br>GGCTTGAGTGGATAGGCATGATTGATCCTTCCAATAGTGACACTAGGTTTAATCCGAACTTCAAG<br>GACAGGGCACATTCACTGTAGACACATCTGCCAGCACAGCCTACATGGAGCTCAGCAGCCTGAC<br>ATCTGAGGACACTGCAGTCTATTACTGTGCCACATATGGTAGCTACGTTTCCCCTCTGGACTACT<br>GGGGTCAAGGAACCTCGGTCACCGTCTCCTCA |
| 504. | ME86H11-L | artificial | aa | DIVMTQTPFSLPVTLGETVSISCKSSQSLLYTSSQKNYLAWYLQKPGQSPQLLIYWASTRESGVP<br>DRFSGSGSGTDFTLKISRVEAEDVGVYYCQQYYAYPWTFGGGTKLEIK |
| 505. | ME86H11-LCDR1 | artificial | aa | KSSQSLLYTSSQKNYLA |
| 506. | ME86H11-LCDR2 | artificial | aa | WASTRES |
| 507. | ME86H11-LCDR3 | artificial | aa | QQYYAYPWT |
| 508. | ME86H11-L | artificial | nt | GACATCGTGATGACCCAGACTCCATTCTCCCTACCTGTGACACTTGGAGAGACGGTTTCTATCAG<br>CTGCAAGTCCAGTCAGTCCCTTTTATATACTAGCAGTCAGAAGAACTACTTGGCCTGGTACCTGC<br>AGAAACCAGGTCAGTCTCCTCAACTGCTGATTTACTGGGCATCCACTAGGGAATCTGGGGTCCCT<br>GATCGCTTCTCAGGCAGTGGATCTGGACAGATTTCACTCTCAAAATCTCCAGAGTGGAGGCTGA<br>GGACGTGGGAGTTTATTACTGTCAGCAATATTATGCCTATCCGTGGACGTTCGGTGGAGGCACAA<br>AGTTGGAGATCAAA |
| 509. | ME86H11-HL | artificial | aa | QVQLVQSGAEVKRPGASVKVSCRASGYTFTSYWLHWVRQGPGQRLEWIGMIDPSNSDTRFNPNFK<br>DRATFTVDTSASTAYMELSSLTSEDTAVYYCATYGSYVSPLDYWGQGTSVTVSSGGGGSGGGGSG<br>GGGSDIVMTQTPFSLPVTLGETVSISCKSSQSLLYTSSQKNYLAWYLQKPGQSPQLLIYWASTRE<br>SGVPDRFSGSGSGTDFTLKISRVEAEDVGVYYCQQYYAYPWTFGGGTKLEIK |

| SEQ ID NO. | DESIGNATION | SOURCE | TYPE | SEQUENCE |
|---|---|---|---|---|
| 510. | ME86H11-HL | artificial | nt | CAGGTGCAGCTGGTCCAGTCTGGGGCTGAAGTGAAGAGGCCTGGGGCTTCAGTGAAGTGTCCTG<br>CAGGGCTTCGGGCTATACCTTCACCAGCTACTGGTTGCACTGGGTTAGACAGGGGCCTGGACAAA<br>GGCTTGAGTGGATAGGCATGATTGATCCTTCCAATAGTGACACTAGGTTTAATCCGAACTTCAAG<br>GACAGGGCCACATTCACTGTAGACACATCTGCCAGCACAGCCTACATGGAGCTCAGCAGCCTGAC<br>ATCTGAGGACACTGCAGTCTATTACTGTGCCACATATGGTAGCTACGTTTCCCCTCTGGACTACT<br>GGGGTCAAGGAACCTCGGTCACCGTCTCCTCAGGTGGTGGTGGTTCTGGCGGCGGCGGCTCCGGT<br>GGTGGTGGTTCTGACATCGTGATGACCCAGACTCCATTCTCCCTACCTGTGACACTTGGAGAGAC<br>GGTTTCTATCAGCTGCAAGTCCAGTCAGTCCCTTTTATATACTAGCAGTCAGAAGAACTACTTGG<br>CCTGGTACCTGCAGAAACCAGGTCAGTCTCCTCAACTGCTGATTTACTGGGCATCCACTAGGGAA<br>TCTGGGGTCCCTGATCGCTTCTCAGGCAGTGGATCTGGGACAGATTTCACTCTCAAAATCTCCAG<br>AGTGGAGGCTGAGGACGTGGGAGTTTATTACTGTCAGCAATATTATGCCTATCCGTGGACGTTCG<br>GTGGAGGCACAAAGTTGGAGATCAAA |
| 511. | ME86H11 HL x I2C HL | artificial | aa | QVQLVQSGAEVKRPGASVKVSCRASGYTFTSYWLHWVRQGPGQRLEWIGMIDPSNSDTRFNPNFK<br>DRATFTVDTSASTAYMELSSLTSEDTAVYYCATYGSYVSPLDYWGQGTSVTVSSGGGGSGGGGSG<br>GGGSDIVMTQTPFSLPVTLGETVSISCKSSQSLLYTSSQKNYLAWYLQKPGQSPQLLIYWASTRE<br>SGVPDRFSGSGSGTDFTLKISRVEAEDVGVYYCQQYYAYPWTFGGGTKLEIKSGGGGSEVQLVES<br>GGGLVQPGGSLKLSCAASGFTFNKYAMNWVRQAPGKGLEWVARIRSKYNNYATYYADSVKDRFTI<br>SRDDSKNTAYLQMNNLKTEDTAVYYCVRHGNFGNSYISYWAYWGQGTLVTVSSGGGGSGGGGSGG<br>GGSQTVVTQEPSLTVSPGGTVTLCGSSTGAVTSGNYPNWVQQKPGQAPRGLIGGTKFLAPGTPA<br>RFSGSLLGKAALTLSGVQPEDEAEYYCVLWYSNRWVFGGGTKLTVL |
| 512. | ME86H11 HL x I2C HL | artificial | nt | CAGGTGCAGCTGGTCCAGTCTGGGGCTGAAGTGAAGAGGCCTGGGGCTTCAGTGAAGTGTCCTG<br>CAGGGCTTCGGGCTATACCTTCACCAGCTACTGGTTGCACTGGGTTAGACAGGGGCCTGGACAAA<br>GGCTTGAGTGGATAGGCATGATTGATCCTTCCAATAGTGACACTAGGTTTAATCCGAACTTCAAG<br>GACAGGGCCACATTCACTGTAGACACATCTGCCAGCACAGCCTACATGGAGCTCAGCAGCCTGAC<br>ATCTGAGGACACTGCAGTCTATTACTGTGCCACATATGGTAGCTACGTTTCCCCTCTGGACTACT<br>GGGGTCAAGGAACCTCGGTCACCGTCTCCTCAGGTGGTGGTGGTTCTGGCGGCGGCGGCTCCGGT<br>GGTGGTGGTTCTGACATCGTGATGACCCAGACTCCATTCTCCCTACCTGTGACACTTGGAGAGAC<br>GGTTTCTATCAGCTGCAAGTCCAGTCAGTCCCTTTTATATACTAGCAGTCAGAAGAACTACTTGG<br>CCTGGTACCTGCAGAAACCAGGTCAGTCTCCTCAACTGCTGATTTACTGGGCATCCACTAGGGAA<br>TCTGGGGTCCCTGATCGCTTCTCAGGCAGTGGATCTGGGACAGATTTCACTCTCAAAATCTCCAG<br>AGTGGAGGCTGAGGACGTGGGAGTTTATTACTGTCAGCAATATTATGCCTATCCGTGGACGTTCG<br>GTGGAGGCACAAAGTTGGAGATCAAATCCGGAGGTGGTGGATCCGAGGTGCAGCTGGTCGAGTCT<br>GGAGGAGGATTGGTGCAGCCTGGAGGGTCATTGAAACTCTCATGTGCAGCCTCTGGATTCACCTT<br>CAATAAGTACGCCATGAACTGGGTCCGCCAGGCTCCAGGAAAGGGTTTGGAATGGGTTGCTCGCA<br>TAAGAAGTAAATATAATAATTATGCAACATATTATGCCGATTCAGTGAAAGACAGGTTCACCATC<br>TCCAGAGATGATTCAAAAACACTGCCTATCTACAAATGAACAACTTGAAACTGAGGACACTGC<br>CGTGTACTACTGTGTGAGACATGGGAACTTCGGTAATAGCTACATATCCTACTGGGCTTACTGGG<br>GCCAAGGGACTCTGGTCACCGTCTCCTCAGGTGGTGGTGGTTCTGCCGGCGGCGGCTCCGGTGGT<br>GGTGGTTCTCAGACTGTTGTGACTCAGGAACCTTCACTCACCGTATCACCTGGTGGAACAGTCAC<br>ACTCACTTGTGGCCTCCTCGACTGGGGCTGTTACATCGGCAACTACCCAAACTGGGTCCAACAAA<br>AACCAGGTCAGGCACCCCGTGGTCTAATAGGTGGGACTAAGTTCCTCGCCCCCGGCTACTCCTGCC<br>AGATTCTCAGGCTCCCTGCTTGGAGGCAAGGCTGCCCTCACCCTCTCAGGGGTACAGCCAGAGGA<br>TGAGGCAGAATATTACTGTGTTCTATGGTACAGCAACCGCTGGGTGTTCGGTGGAGGAACCAAAC<br>TGACTGTCCTA |
| 513. | ME62A12-H | artificial | aa | QVQLVQSGAEVVKPGASVKVSCKASGYTFTSYWLHWVRQTPGQGLEWIGMIDPSNSDTRFNPNFK<br>DKVTFTVDTSASTAYMELSSLRSEDTAVYYCATYGSYVSPLDYWGQGTSVTVSS |
| 514. | ME62A12-HCDR1 | artificial | aa | SYWLH |
| 515. | ME62A12-HCDR2 | artificial | aa | MIDPSNSDTRFNPNFKD |
| 516. | ME62A12-HCDR3 | artificial | aa | YGSYVSPLDY |
| 517. | ME62A12-H | artificial | nt | CAGGTGCAGCTGGTCCAGTCTGGGGCTGAAGTGGTGAAGCCTGGGGCTTCAGTGAAGTGTCCTG<br>CAAGGCTTCGGGCTATACCTTCACCAGCTACTGGTTGCACTGGGTTAGACAGACGCCTGGACAAG<br>GGCTTGAGTGGATAGGCATGATTGATCCTTCCAATAGTGACACTAGGTTTAATCCGAACTTCAAG<br>GACAAGGTCACATTCACTGTAGACACATCTGCCAGCACAGCCTACATGGAACTCAGCAGCCTGAG<br>ATCTGAGGACACTGCAGTCTATTACTGTGCCACATATGGTAGCTACGTTTCCCCTCTGGACTACT<br>GGGGTCAAGGAACCTCGGTCACCGTCTCCTCA |
| 518. | ME62A12-L | artificial | aa | DIVMTQTPLSLPVTLGEKVSVSCKSSQSLLYTSSQKNYLAWYQQKPGQSPKLLIYWASTRESGVP<br>DRFSGSGSGTDFTLTISRVEAEDLGVYYCQQYYAYPWTFGGGTKLEIK |
| 519. | ME62A12-LCDR1 | artificial | aa | KSSQSLLYTSSQKNYLA |
| 520. | ME62A12-LCDR2 | artificial | aa | WASTRES |
| 521. | ME62A12-LCDR3 | artificial | aa | QQYYAYPWT |
| 522. | ME62A12-L | artificial | nt | GACATCGTGATGACCCAGACTCCACTCTCCCTACCTGTGACACTTGGAGAGAAGGTTTCTGTCAG<br>CTGCAAGTCCAGTCAGTCCCTTTTATATACTAGCAGTCAGAAGAACTACTTGGCCTGGTACCAGC<br>AGAAACCAGGTCAGTCTCCTAAACTGCTGATTTACTGGGCATCCACTAGGGAATCTGGGGTCCCT |

| SEQ ID NO. | DESIGNATION | SOURCE | TYPE | SEQUENCE |
|---|---|---|---|---|
| | | | | GATCGCTTCTCAGGCAGTGGATCTGGGACAGATTTCACTCTCACAATCTCCAGAGTGGAGGCTGA GGAACCTGGGAGTTTATTACTGTCAGCAATATTATGCCTATCCGTGGACGTTCGGTGGAGGCACAA AGTTGGAGATCAAA |
| 523. | ME62A12-HL | artificial | aa | QVQLVQSGAEVVKPGASVKVSCKASGYTFTSYWLHWVRQTPGQGLEWIGMIDPSNSDTRFNPNFK DKVTFTVDTSASTAYMELSSLRSEDTAVYYCATYGSYVSPLDYWGQGTSVTVSSGGGGSGGGGSG GGGSDIVMTQTPLSLPVTLGEKVSVSCKSSQSLLYTSSQKNYLAWYQQKPGQSPKLLIYWASTRE SGVPDRFSGSGSGTDFTLTISRVEAEDLGVYYCQQYYAYPWTFGGGTKLEIK |
| 524. | ME62A12-HL | artificial | nt | CAGGTGCAGCTGGTCCAGTCTGGGGCTGAAGTGGTGAAGCCTGGGGCTTCAGTGAAAGTGTCCTG CAAGGCTTCGGGCTATACCTTCACCAGCTACTGGTTGCACTGGGTTAGACAGACGCCTGGACAAG GGCTTGAGTGGATAGGCATGATTGATCCTTCCAATAGTGACACTAGGTTTAATCCGAACTTCAAG GACAAGGTCACATTCACTGTAGACACATCTGCCAGCACAGCCTACATGGAACTCAGCAGCCTGAG ATCTGAGGACACTGCAGTCTATTACTGTGCCACATATGGTAGCTACGTTTCCCCTCTGGACTACT GGGGTCAAGGAACCTCGGTCACCGTCTCCTCAGGTGGTGGTGGTTCTGGCGGCGGCGGCTCCGGT GGTGGTGGTTCTGACATCGTGATGACCCAGACTCCACTCTCCCTACCTGTGACACTTGGAGAGAA GGTTTCTGTCAGCTGCAAGTCCAGTCAGTCCCTTTTATATACTAGCAGTCAGAAGAACTACTTGG CCTGGTACCAGCAGAAACCAGGTCAGTCTCCTAAACTGCTGATTTACTGGGCATCCACTAGGGAA TCTGGGGTCCCTGATCGCTTCTCAGGCAGTGGATCTGGGACAGATTTCACTCTCACAATCTCCAG AGTGGAGGCTGAGGACCTGGGAGTTTATTACTGTCAGCAATATTATGCCTATCCGTGGACGTTCG GTGGAGGCACAAAGTTGGAGATCAAA |
| 525. | ME62A12 HL x I2C HL | artificial | aa | QVQLVQSGAEVVKPGASVKVSCKASGYTFTSYWLHWVRQTPGQGLEWIGMIDPSNSDTRFNPNFK DKVTFTVDTSASTAYMELSSLRSEDTAVYYCATYGSYVSPLDYWGQGTSVTVSSGGGGSGGGGSG GGGSDIVMTQTPLSLPVTLGEKVSVSCKSSQSLLYTSSQKNYLAWYQQKPGQSPKLLIYWASTRE SGVPDRFSGSGSGTDFTLTISRVEAEDLGVYYCQQYYAYPWTFGGGTKLEIKSGGGGSEVQLVES GGGLVQPGGSLKLSCAASGFTFNKYAMNWVRQAPGKGLEWVARIRSKYNNYATYYADSVKDRFTI SRDDSKNTAYLQMNNLKTEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQAPRGLIGGTKFLAPGTPA RFSGSLLGGKAALTLSGVQPEDEAEYYCVLWYSNRWVFGGGTKLTVL |
| 526. | ME62A12 HL x I2C HL | artificial | nt | CAGGTGCAGCTGGTCCAGTCTGGGGCTGAAGTGGTGAAGCCTGGGGCTTCAGTGAAAGTGTCCTG CAAGGCTTCGGGCTATACCTTCACCAGCTACTGGTTGCACTGGGTTAGACAGACGCCTGGACAAG GGCTTGAGTGGATAGGCATGATTGATCCTTCCAATAGTGACACTAGGTTTAATCCGAACTTCAAG GACAAGGTCACATTCACTGTAGACACATCTGCCAGCACAGCCTACATGGAACTCAGCAGCCTGAG ATCTGAGGACACTGCAGTCTATTACTGTGCCACATATGGTAGCTACGTTTCCCCTCTGGACTACT GGGGTCAAGGAACCTCGGTCACCGTCTCCTCAGGTGGTGGTGGTTCTGGCGGCGGCGGCTCCGGT GGTGGTGGTTCTGACATCGTGATGACCCAGACTCCACTCTCCCTACCTGTGACACTTGGAGAGAA GGTTTCTGTCAGCTGCAAGTCCAGTCAGTCCCTTTTATATACTAGCAGTCAGAAGAACTACTTGG CCTGGTACCAGCAGAAACCAGGTCAGTCTCCTAAACTGCTGATTTACTGGGCATCCACTAGGGAA TCTGGGGTCCCTGATCGCTTCTCAGGCAGTGGATCTGGGACAGATTTCACTCTCACAATCTCCAG AGTGGAGGCTGAGGACCTGGGAGTTTATTACTGTCAGCAATATTATGCCTATCCGTGGACGTTCG GTGGAGGCACAAAGTTGGAGATCAAATCCGGAGGTGGTGGATCCGAGGTGCAGCTGGTCGAGTCT GGAGGAGGATTGGTGCAGCCTGGAGGGTCATTGAAACTCTCATGTGCAGCCTCTGGATTCACCTT CAATAAGTACGCCATGAACTGGGTCCGCCAGGCTCCAGGAAAGGGTTTGGAATGGGTTGCTCGCA TAAGAAGTAAATATAATAATTATGCAACATATTATGCCGATTCAGTGAAAGACAGGTTCACCATC TCCAGAGATGATTCAAAAAACACTGCCTATCTACAAATGAACAACTTGAAAACTGAGGACACTGC CGTGTACTACTGTGTGAGACATGGGAACTTCGGTAATAGCTACATATCCTACTGGGCTTACTGGG GCCAAGGGACTCTGGTCACCGTCTCCTCAGGTGGTGGTGGTTCTGGCGGCGGCGGCTCCGGTGGT GGTGGTTCTCAGACTGTTGTGACTCAGGAACCTTCACTCACCGTATCACCTGGTGGAACAGTCAC ACTCACTTGTGGCTCCTCGACTGGGGCTGTTACATCTGGCAACTACCCAAACTGGGTCCAACAAA AACCAGGTCAGGCACCCCGTGGTCTAATAGGTGGGACTAAGTTCCTCGCCCCCGGTACTCCTGCC AGATTCTCAGGCTCCCTGCTTGGAGGCAAGGCTGCCCTCACCCTCTCAGGGGTACAGCCAGAGGA TGAGGCAGAATATTACTGTGTTCTATGGTACAGCAACCGCTGGGTGTTCGGTGGAGGAACCAAAC TGACTGTCCTA |
| 527. | ME63F2-H | artificial | aa | QVQLVQSGAEVVKRPGASVKVSCKASGYTFTSYWLHWVRQTPGQRLEWIGMIDPSNSDTRFNPNFK DRVTMTVDTSANTAYMELSSLRSEDTAVYYCATYGSYVSPLDYWGQGTSVTVSS |
| 528. | ME63F2-HCDR1 | artificial | aa | SYWLH |
| 529. | ME63F2-HCDR2 | artificial | aa | MIDPSNSDTRFNPNFKD |
| 530. | ME63F2-HCDR3 | artificial | aa | YGSYVSPLDY |
| 531. | ME63F2-H | artificial | nt | CAGGTGCAGCTGGTCCAGTCTGGGGCTGAAGTGAAGAGGCCTGGGGCTTCAGTGAAAGTGTCCTG CAAGGCTTCGGGCTATACCTTCACCAGCTACTGGTTGCACTGGGTTAGACAGACGCCTGGACAAA GGCTTGAGTGGATAGGCATGATTGATCCTTCCAATAGTGACACTAGGTTTAATCCGAACTTCAAG GACAGGGTCACAATGACTGTAGACACATCTGCCAACACAGCCTACATGGAACTCAGCAGCCTGAG ATCTGAGGACACTGCAGTCTATTACTGTGCCACATATGGTAGCTACGTTTCCCCTCTGGACTACT GGGGTCAAGGAACCTCGGTCACCGTCTCCTCA |
| 532. | ME63F2-L | artificial | aa | DIVMTQTPLSLPVTVGEQASISCKSSQSLLYTSSQKNYLAWYQQKPGQSPKLLIYWASTRESGVP DRFSGSGSGTDFTLKISRVEAEDLGVYYCQQYYAYPWTFGGGTKLEIK |

| SEQ ID NO. | DESIGNATION | SOURCE | TYPE | SEQUENCE |
|---|---|---|---|---|
| 533. | ME63F2-LCDR1 | artificial | aa | KSSQSLLYTSSQKNYLA |
| 534. | ME63F2-LCDR2 | artificial | aa | WASTRES |
| 535. | ME63F2-LCDR3 | artificial | aa | QQYYAYPWT |
| 536. | ME63F2-L | artificial | nt | GACATCGTGATGACCCAGACTCCACTCTCCCTACCTGTGACAGTTGGAGAGCAGGCTTCTATCAG CTGCAAGTCCAGTCAGTCCCTTTTATATACTAGCAGTCAGAAGAACTACTTGGCCTGGTACCAGC AGAAACCAGGTCAGTCTCCTAAACTGCTGATTTACTGGGCATCCACTAGGGAATCTGGGGTCCCT GATCGCTTCTCAGGCAGTGGATCTGGGACAGATTTCACTCTCAAAATCTCCAGAGTGGAGGCTGA GGACCTGGGAGTTTATTACTGTCAGCAATATTATGCCTATCCGTGGACGTTCGGTGGAGGCACAA AGTTGGAGATCAAA |
| 537. | ME63F2-HL | artificial | aa | QVQLVQSGAEVKRPGASVKVSCKASGYTFTSYWLHWVRQTPGQRLEWIGMIDPSNSDTRFNPNFK DRVTMTVDTSANTAYMELSSLRSEDTAVYYCATYGSYVSPLDYWGQGTSVTVSSGGGGSGGGGSG GGGSDIVMTQTPLSLPVTVGEQASISCKSSQSLLYTSSQKNYLAWYQQKPGQSPKLLIYWASTRE SGVPDRFSGSGSGTDFTLKISRVEAEDLGVYYCQQYYAYPWTFGGGTKLEIK |
| 538. | ME63F2-HL | artificial | nt | CAGGTGCAGCTGGTCCAGTCTGGGGCTGAAGTGAAGAGGCCTGGGGCTTCAGTGAAAGTGTCCTG CAAGGCTTCGGGCTATACCTTCACCAGCTACTGGTTGCACTGGGTTAGACAGACGCCTGGACAAA GGCTTGAGTGGATAGGCATGATTGATCCTTCCAATAGTGACACTAGGTTTAATCCGAACTTCAAG GACAGGGTCACAATGACTGTAGACACATCTGCCAACACAGCCTACATGGAACTCAGCAGCCTGAG ATCTGAGGACACTGCAGTCTATTACTGTGCCACATATGGTAGCTACGTTTCCCCTCTGGACTACT GGGGTCAAGGAACCTCGGTCACCGTCTCCTCAGGTGGTGGTGGTTCTGGCGGCGGCGGCTCCGGT GGTGGTGGTTCTGACATCGTGATGACCCAGACTCCACTCTCCCTACCTGTGACAGTTGGAGAGCA GGCTTCTATCAGCTGCAAGTCCAGTCAGTCCCTTTTATATACTAGCAGTCAGAAGAACTACTTGG CCTGGTACCAGCAGAAACCAGGTCAGTCTCCTAAACTGCTGATTTACTGGGCATCCACTAGGGAA TCTGGGGTCCCTGATCGCTTCTCAGGCAGTGGATCTGGGACAGATTTCACTCTCAAAATCTCCAG AGTGGAGGCTGAGGACCTGGGAGTTTATTACTGTCAGCAATATTATGCCTATCCGTGGACGTTCG GTGGAGGCACAAAGTTGGAGATCAAA |
| 539. | ME63F2 HL x I2C HL | artificial | aa | QVQLVQSGAEVKRPGASVKVSCKASGYTFTSYWLHWVRQTPGQRLEWIGMIDPSNSDTRFNPNFK DRVTMTVDTSANTAYMELSSLRSEDTAVYYCATYGSYVSPLDYWGQGTSVTVSSGGGGSGGGGSG GGGSDIVMTQTPLSLPVTVGEQASISCKSSQSLLYTSSQKNYLAWYQQKPGQSPKLLIYWASTRE SGVPDRFSGSGSGTDFTLKISRVEAEDLGVYYCQQYYAYPWTFGGGTKLEIKSGGGGSEVQLVES GGGLVQPGGSLKLSCAASGFTFNKYAMNWVRQAPGKGLEWVARIRSKYNNYATYYADSVKDRFTI SRDDSKNTAYLQMNNLKTEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQAPRGLIGGTKFLAPGTPA RFSGSLLGGKAALTLSGVQPEDEAEYYCVLWYSNRWVFGGGTKLTVL |
| 540. | ME63F2 HL x I2C HL | artificial | nt | CAGGTGCAGCTGGTCCAGTCTGGGGCTGAAGTGAAGAGGCCTGGGGCTTCAGTGAAAGTGTCCTG CAAGGCTTCGGGCTATACCTTCACCAGCTACTGGTTGCACTGGGTTAGACAGACGCCTGGACAAA GGCTTGAGTGGATAGGCATGATTGATCCTTCCAATAGTGACACTAGGTTTAATCCGAACTTCAAG GACAGGGTCACAATGACTGTAGACACATCTGCCAACACAGCCTACATGGAACTCAGCAGCCTGAG ATCTGAGGACACTGCAGTCTATTACTGTGCCACATATGGTAGCTACGTTTCCCCTCTGGACTACT GGGGTCAAGGAACCTCGGTCACCGTCTCCTCAGGTGGTGGTGGTTCTGGCGGCGGCGGCTCCGGT GGTGGTGGTTCTGACATCGTGATGACCCAGACTCCACTCTCCCTACCTGTGACAGTTGGAGAGCA GGCTTCTATCAGCTGCAAGTCCAGTCAGTCCCTTTTATATACTAGCAGTCAGAAGAACTACTTGG CCTGGTACCAGCAGAAACCAGGTCAGTCTCCTAAACTGCTGATTTACTGGGCATCCACTAGGGAA TCTGGGGTCCCTGATCGCTTCTCAGGCAGTGGATCTGGGACAGATTTCACTCTCAAAATCTCCAG AGTGGAGGCTGAGGACCTGGGAGTTTATTACTGTCAGCAATATTATGCCTATCCGTGGACGTTCG GTGGAGGCACAAAGTTGGAGATCAAATCCGGAGGTGGTGGATCCGAGGTGCAGCTGGTCGAGTCT GGAGGAGGATTGGTGCAGCCTGGAGGGTCATTGAAACTCTCATGTGCAGCCTCTGGATTCACCTT CAATAAGTACGCCATGAACTGGGTCCGCCAGGCTCCAGGAAAGGGTTTGGAATGGGTTGCTCGCA TAAGAAGTAAATATAATAATTATGCAACATATTATGCCGATTCAGTGAAAGACAGGTTCACCATC TCCAGAGATGATTCAAAAACACTGCCTATCTACAAATGAACAACTTGAAAACTGAGGACACTGC CGTGTACTACTGTGTGAGACATGGGAACTTCGGTAATAGCTACATATCCTACTGGGCTTACTGGG GCCAAGGGACTCTGGTCACCGTCTCCTCAGGTGGTGGTGGTTCTGGCGGCGGCGGCTCCGGTGGT GGTGGTTCTCAGACTGTTGTGACTCAGGAACCTTCACTCACCGTATCACCTGGTGGAACAGTCAC ACTCACTTGTGGCTCCTCGACTGGGGCTGTTACATCGGCAACTACCCAAACTGGGTCCAACAAA AACCAGGTCAGGCACCCCGTGGTCTAATAGGTGGGACTAAGTTCCTCGCCCCCGGTACTCCTGCC AGATTCTCAGGCTCCCTGCTTGGAGGCAAGGCTGCCCTCACCCTCTCAGGGGTACAGCCAGAGGA TGAGGCAGAATATTACTGTGTTCTATGGTACAGCAACCGCTGGGTGTTCGGTGGAGGAACCAAAC TGACTGTCCTA |
| 541. | ME62D11-H | artificial | aa | QVQLVQSGPEVVKPGASVKVSCKASGYTFTSYWLHWVKQAPGQGLEWIGMIDPSNSDTRFNPNFK DRATLTVDTSASTAYMLLSSLRSEDTAVYYCATYGSYVSPLDYWGQGTSVTVSS |
| 542. | ME62D11-HCDR1 | artificial | aa | SYWLH |
| 543. | ME62D11-HCDR2 | artificial | aa | MIDPSNSDTRFNPNFKD |
| 544. | ME62D11-HCDR3 | artificial | aa | YGSYVSPLDY |

| SEQ ID NO. | DESIGNATION | SOURCE | TYPE | SEQUENCE |
|---|---|---|---|---|
| 545. | ME62D11-H | artificial | nt | CAGGTGCAGCTGGTCCAGTCTGGGCCTGAAGTGGTGAAGCCTGGGGCTTCAGTGAAAGTGTCCTG<br>CAAGGCTTCGGGCTATACCTTCACCAGCTACTGGTTGCACTGGGTTAAACAGGCGCCTGGACAAG<br>GGCTTGAGTGGATAGGCATGATTGATCCTTCCAATAGTGACACTAGGTTTAATCCGAACTTCAAG<br>GACAGGGCCACATTGACTGTAGACACATCTGCCAGCACAGCCTACATGCTACTCAGCAGCCTGAG<br>ATCTGAGGACACTGCAGTCTATTACTGTGCCACATATGGTAGCTACGTTTCCCCTCTGGACTACT<br>GGGGTCAAGGAACCTCGGTCACCGTCTCCTCA |
| 546. | ME62D11-L | artificial | aa | DIVMTQTPSSLPVTLGETVSISCKSSQSLLYTSSQKNYLAWYLQKPGQSPQLLIYWASTRESGVP<br>DRFSGSGSGTDFTLTISRVKAEDVAVYYCQQYYAYPWTFGGGTKLEIK |
| 547. | ME62D11-LCDR1 | artificial | aa | KSSQSLLYTSSQKNYLA |
| 548. | ME62D11-LCDR2 | artificial | aa | WASTRES |
| 549. | ME62D11-LCDR3 | artificial | aa | QQYYAYPWT |
| 550. | ME62D11-L | artificial | nt | GACATCGTGATGACCCAGACTCCATCCTCCCTACCTGTGACACTTGGAGAGACGGTTTCTATCAG<br>CTGCAAGTCCAGTCAGTCCCTTTTATATACTAGCAGTCAGAAGAACTACTTGGCCTGGTACCTGC<br>AGAAACCAGGTCAGTCTCCTCAACTGCTGATTTACTGGGCATCCACTAGGGAATCTGGGGTCCCT<br>GATCGCTTCTCAGGCAGTGGATCTGGGACAGATTTCACTCTCACAATCTCCAGAGTGAAGGCTGA<br>GGACGTGGCAGTTTATTACTGTCAGCAATATTATGCCTATCCGTGGACGTTCGGTGGAGGCACAA<br>AGTTGGAGATCAAA |
| 551. | ME62D11-HL | artificial | aa | QVQLVQSGPEVVKPGASVKVSCKASGYTFTSYWLHWVKQAPGQGLEWIGMIDPSNSDTRFNPNFK<br>DRATLTVDTSASTAYMLLSSLRSEDTAVYYCATYGSYVSPLDYWGQGTSVTVSSGGGGSGGGGSG<br>GGGSDIVMTQTPSSLPVTLGETVSISCKSSQSLLYTSSQKNYLAWYLQKPGQSPQLLIYWASTRE<br>SGVPDRFSGSGSGTDFTLTISRVKAEDVAVYYCQQYYAYPWTFGGGTKLEIK |
| 552. | ME62D11-HL | artificial | nt | CAGGTGCAGCTGGTCCAGTCTGGGCCTGAAGTGGTGAAGCCTGGGGCTTCAGTGAAAGTGTCCTG<br>CAAGGCTTCGGGCTATACCTTCACCAGCTACTGGTTGCACTGGGTTAAACAGGCGCCTGGACAAG<br>GGCTTGAGTGGATAGGCATGATTGATCCTTCCAATAGTGACACTAGGTTTAATCCGAACTTCAAG<br>GACAGGGCCACATTGACTGTAGACACATCTGCCAGCACAGCCTACATGCTACTCAGCAGCCTGAG<br>ATCTGAGGACACTGCAGTCTATTACTGTGCCACATATGGTAGCTACGTTTCCCCTCTGGACTACT<br>GGGGTCAAGGAACCTCGGTCACCGTCTCCTCAGGTGGTGGTGGTTCTGGCGGCGGCGGCTCCGGT<br>GGTGGTGGTTCTGACATCGTGATGACCCAGACTCCATCCTCCCTACCTGTGACACTTGGAGAGAC<br>GGTTTCTATCAGCTGCAAGTCCAGTCAGTCCCTTTTATATACTAGCAGTCAGAAGAACTACTTGG<br>CCTGGTACCTGCAGAAACCAGGTCAGTCTCCTCAACTGCTGATTTACTGGGCATCCACTAGGGAA<br>TCTGGGGTCCCTGATCGCTTCTCAGGCAGTGGATCTGGGACAGATTTCACTCTCACAATCTCCAG<br>AGTGAAGGCTGAGGACGTGGCAGTTTATTACTGTCAGCAATATTATGCCTATCCGTGGACGTTCG<br>GTGGAGGCACAAAGTTGGAGATCAAA |
| 553. | ME62D11 HL x I2C HL | artificial | aa | QVQLVQSGPEVVKPGASVKVSCKASGYTFTSYWLHWVKQAPGQGLEWIGMIDPSNSDTRFNPNFK<br>DRATLTVDTSASTAYMLLSSLRSEDTAVYYCATYGSYVSPLDYWGQGTSVTVSSGGGGSGGGGSG<br>GGGSDIVMTQTPSSLPVTLGETVSISCKSSQSLLYTSSQKNYLAWYLQKPGQSPQLLIYWASTRE<br>SGVPDRFSGSGSGTDFTLTISRVKAEDVAVYYCQQYYAYPWTFGGGTKLEIKSGGGGSEVQLVES<br>GGGLVQPGGSLKLSCAASGFTFNKYAMNWVRQAPGKGLEWVARIRSKYNNYATYYADSVKDRFTI<br>SRDDSKNTAYLQMNNLKTEDTAVYYCVRHGNFGNSYISYWAYWGQGTLVTVSSGGGGSGGGGSGG<br>GGSQTVVTQEPSLTVSPGGTVTLTCGSSTGAVTSGNYPNWVQQKPGQAPRGLIGGTKFLAPGTPA<br>RFSGSLLGGKAALTLSGVQPEDEAEYYCVLWYSNRWVFGGGTKLTVL |
| 554. | ME62D11 HL x I2C HL | artificial | nt | CAGGTGCAGCTGGTCCAGTCTGGGCCTGAAGTGGTGAAGCCTGGGGCTTCAGTGAAAGTGTCCTG<br>CAAGGCTTCGGGCTATACCTTCACCAGCTACTGGTTGCACTGGGTTAAACAGGCGCCTGGACAAG<br>GGCTTGAGTGGATAGGCATGATTGATCCTTCCAATAGTGACACTAGGTTTAATCCGAACTTCAAG<br>GACAGGGCCACATTGACTGTAGACACATCTGCCAGCACAGCCTACATGCTACTCAGCAGCCTGAG<br>ATCTGAGGACACTGCAGTCTATTACTGTGCCACATATGGTAGCTACGTTTCCCCTCTGGACTACT<br>GGGGTCAAGGAACCTCGGTCACCGTCTCCTCAGGTGGTGGTGGTTCTGGCGGCGGCGGCTCCGGT<br>GGTGGTGGTTCTGACATCGTGATGACCCAGACTCCATCCTCCCTACCTGTGACACTTGGAGAGAC<br>GGTTTCTATCAGCTGCAAGTCCAGTCAGTCCCTTTTATATACTAGCAGTCAGAAGAACTACTTGG<br>CCTGGTACCTGCAGAAACCAGGTCAGTCTCCTCAACTGCTGATTTACTGGGCATCCACTAGGGAA<br>TCTGGGGTCCCTGATCGCTTCTCAGGCAGTGGATCTGGGACAGATTTCACTCTCACAATCTCCAG<br>AGTGAAGGCTGAGGACGTGGCAGTTTATTACTGTCAGCAATATTATGCCTATCCGTGGACGTTCG<br>GTGGAGGCACAAAGTTGGAGATCAAATCCGGAGGTGGTGGATCCGAGGTGCAGCTGGTCGAGTCT<br>GGAGGAGGATTGGTGCAGCCTGGAGGGTCATTGAAACTCTCATGTGCAGCCTCTGGATTCACCTT<br>CAATAAGTACGCCATGAACTGGGTCCGCCAGGCTCCAGGAAAGGGTTTGGAATGGGTTGCTCGCA<br>TAAGAAGTAAATATAATAATTATGCAACATATTATGCCGATTCAGTGAAAGACAGGTTCACCATC<br>TCCAGAGATGATTCAAAAACACTGCCTATCTACAAATGAACAACTTGAAACTGAGGACACTGC<br>CGTGTACTACTGTGTGAGACATGGGAACTTCGGTAATAGCTACATATCCTACTGGGCTTACTGGG<br>GCCAAGGGACTCTGGTCACCGTCTCCTCAGGTGGTGGTGGTTCTGGCGGCGGCGGCTCCGGTGGT<br>GGTGGTTCTCAGACTGTTGTGACTCAGGAACCTTCACTCACCGTATCACCTGGTGGAACAGTCAC<br>ACTCACTTGTGGCTCCTCGACTGGGGCTGTTACATCTGGCAACTACCCAAACTGGGTCCAACAAA<br>AACCAGGTCAGGCACCCCGTGGTCTAATAGGTGGGACTAAGTTCCTCGCCCCCGGTACTCCTGCC<br>AGATTCTCAGGCTCCCTGCTTGGAGGCAAGGCTGCCCTCACCCTCTCAGGGGTACAGCCAGAGGA<br>TGAGGCAGAATATTACTGTGTTCTATGGTACAGCAACCGCTGGGTGTTCGGTGGAGGAACCAAAC<br>TGACTGTCCTA |

| SEQ ID NO. | DESIGNATION | SOURCE | TYPE | SEQUENCE |
|---|---|---|---|---|
| 555. | ME62C10-H | artificial | aa | QVQLVQSGAELKKPGASVKVSCKASGYTFTSYWLHWVKQAPGQRLEWIGMIDPSNSDTRFNPNFK<br>DRVTITVDTSANTAYMELSSLRSEDTAVYYCATYGSYVSPLDYWGQGTSVTVSS |
| 556. | ME62C10-HCDR1 | artificial | aa | SYWLH |
| 557. | ME62C10-HCDR2 | artificial | aa | MIDPSNSDTRFNPNFKD |
| 558. | ME62C10-HCDR3 | artificial | aa | YGSYVSPLDY |
| 559. | ME62C10-H | artificial | nt | CAGGTGCAGCTGGTCCAGTCTGGGGCTGAACTGAAGAAGCCTGGGGCTTCAGTGAAAGTGTCCTG<br>CAAGGCTTCGGGCTATACCTTCACCAGCTACTGGTTGCACTGGGTTAAACAGGCGCCTGGACAAA<br>GGCTTGAGTGGATAGGCATGATTGATCCTTCCAATAGTGACACTAGGTTTAATCCGAACTTCAAG<br>GACAGGGTCACAATCACTGTAGACACATCTGCCAACACAGCCTACATGGAGCTCAGCAGCCTGAG<br>ATCTGAGGACACTGCAGTCTATTACTGTGCCACATATGGTAGCTACGTTTCCCCTCTGGACTACT<br>GGGGTCAAGGAACCTCGGTCACCGTCTCCTCA |
| 560. | ME62C10-L | artificial | aa | DIVMTQTPPSLTVTPGEQVSISCKSSQSLLYTSSQKNYLAWYLQKPGQSPKLLIYWASTRESGVP<br>DRFSGSGSGTDFTLKISSVEADDVGVYYCQQYYAYPWTFGGGTKLEIK |
| 561. | ME62C10-LCDR1 | artificial | aa | KSSQSLLYTSSQKNYLA |
| 562. | ME62C10-LCDR2 | artificial | aa | WASTRES |
| 563. | ME62C10-LCDR3 | artificial | aa | QQYYAYPWT |
| 564. | ME62C10-L | artificial | nt | GACATCGTGATGACCCAGACTCCACCCTCCCTAACTGTGACACCTGGAGAGCAGGTTTCTATCAG<br>CTGCAAGTCCAGTCAGTCCCTTTTATATACTAGCAGTCAGAAGAACTACTTGGCCTGGTACCTGC<br>AGAAACCAGGTCAGTCTCCTAAACTGCTGATTTACTGGGCATCCACTAGGGAATCTGGGGTCCCT<br>GATCGCTTCTCAGGCAGTGGATCTGGGACAGATTTCACTCTCAAAATCTCCAGTGTGGAGGCTGA<br>CGACGTGGGAGTTTATTACTGTCAGCAATATTATGCCTATCCGTGGACGTTCGGTGGAGGCACAA<br>AGTTGGAGATCAAA |
| 565. | ME62C10-HL | artificial | aa | QVQLVQSGAELKKPGASVKVSCKASGYTFTSYWLHWVKQAPGQRLEWIGMIDPSNSDTRFNPNFK<br>DRVTITVDTSANTAYMELSSLRSEDTAVYYCATYGSYVSPLDYWGQGTSVTVSSGGGGSGGGGSG<br>GGGSDIVMTQTPPSLTVTPGEQVSISCKSSQSLLYTSSQKNYLAWYLQKPGQSPKLLIYWASTRE<br>SGVPDRFSGSGSGTDFTLKISSVEADDVGVYYCQQYYAYPWTFGGGTKLEIK |
| 566. | ME62C10-HL | artificial | nt | CAGGTGCAGCTGGTCCAGTCTGGGGCTGAACTGAAGAAGCCTGGGGCTTCAGTGAAAGTGTCCTG<br>CAAGGCTTCGGGCTATACCTTCACCAGCTACTGGTTGCACTGGGTTAAACAGGCGCCTGGACAAA<br>GGCTTGAGTGGATAGGCATGATTGATCCTTCCAATAGTGACACTAGGTTTAATCCGAACTTCAAG<br>GACAGGGTCACAATCACTGTAGACACATCTGCCAACACAGCCTACATGGAGCTCAGCAGCCTGAG<br>ATCTGAGGACACTGCAGTCTATTACTGTGCCACATATGGTAGCTACGTTTCCCCTCTGGACTACT<br>GGGGTCAAGGAACCTCGGTCACCGTCTCCTCAGGTGGTGGTGGTTCTGGCGGCGGCGGCTCCGGT<br>GGTGGTGGTTCTGACATCGTGATGACCCAGACTCCACCCTCCCTAACTGTGACACCTGGAGAGCA<br>GGTTTCTATCAGCTGCAAGTCCAGTCAGTCCCTTTTATATACTAGCAGTCAGAAGAACTACTTGG<br>CCTGGTACCTGCAGAAACCAGGTCAGTCTCCTAAACTGCTGATTTACTGGGCATCCACTAGGGAA<br>TCTGGGGTCCCTGATCGCTTCTCAGGCAGTGGATCTGGGACAGATTTCACTCTCAAAATCTCCAG<br>TGTGGAGGCTGACGACGTGGGAGTTTATTACTGTCAGCAATATTATGCCTATCCGTGGACGTTCG<br>GTGGAGGCACAAAGTTGGAGATCAAA |
| 567. | ME62C10 HL x I2C HL | artificial | aa | QVQLVQSGAELKKPGASVKVSCKASGYTFTSYWLHWVKQAPGQRLEWIGMIDPSNSDTRFNPNFK<br>DRVTITVDTSANTAYMELSSLRSEDTAVYYCATYGSYVSPLDYWGQGTSVTVSSGGGGSGGGGSG<br>GGGSDIVMTQTPPSLTVTPGEQVSISCKSSQSLLYTSSQKNYLAWYLQKPGQSPKLLIYWASTRE<br>SGVPDRFSGSGSGTDFTLKISSVEADDVGVYYCQQYYAYPWTFGGGTKLEIKSGGGGSEVQLVES<br>GGGLVQPGGSLKLSCAASGFTFNKYAMNWVRQAPGKGLEWVARIRSKYNNYATYYADSVKDRFTI<br>SRDDSKNTAYLQMNNLKTEDTAVYYCVRHGNFGNSYISYWAYWGQGTLVTVSSGGGGSGGGGSGG<br>GGSQTVVTQEPSLTVSPGGTVTLTCGSSTGAVTSGNYPNWVQQKPGQAPRGLIGGTKFLAPGTPA<br>RFSGSLLGGKAALTLSGVQPEDEAEYYCVLWYSNRWVFGGGTKLTVL |
| 568. | ME62C10 HL x I2C HL | artificial | nt | CAGGTGCAGCTGGTCCAGTCTGGGGCTGAACTGAAGAAGCCTGGGGCTTCAGTGAAAGTGTCCTG<br>CAAGGCTTCGGGCTATACCTTCACCAGCTACTGGTTGCACTGGGTTAAACAGGCGCCTGGACAAA<br>GGCTTGAGTGGATAGGCATGATTGATCCTTCCAATAGTGACACTAGGTTTAATCCGAACTTCAAG<br>GACAGGGTCACAATCACTGTAGACACATCTGCCAACACAGCCTACATGGAGCTCAGCAGCCTGAG<br>ATCTGAGGACACTGCAGTCTATTACTGTGCCACATATGGTAGCTACGTTTCCCCTCTGGACTACT<br>GGGGTCAAGGAACCTCGGTCACCGTCTCCTCAGGTGGTGGTGGTTCTGGCGGCGGCGGCTCCGGT<br>GGTGGTGGTTCTGACATCGTGATGACCCAGACTCCACCCTCCCTAACTGTGACACCTGGAGAGCA<br>GGTTTCTATCAGCTGCAAGTCCAGTCAGTCCCTTTTATATACTAGCAGTCAGAAGAACTACTTGG<br>CCTGGTACCTGCAGAAACCAGGTCAGTCTCCTAAACTGCTGATTTACTGGGCATCCACTAGGGAA<br>TCTGGGGTCCCTGATCGCTTCTCAGGCAGTGGATCTGGGACAGATTTCACTCTCAAAATCTCCAG<br>TGTGGAGGCTGACGACGTGGGAGTTTATTACTGTCAGCAATATTATGCCTATCCGTGGACGTTCG<br>GTGGAGGCACAAAGTTGGAGATCAAATCGGAGGTGGTGGATCCGAGGTGCAGCTGGTCGAGTCT<br>GGAGGAGGATTGGTGCAGCCTGGAGGGTCATTGAAACTCTCATGTGCAGCCTCTGGATTCACCTT<br>CAATAAGTACGCCATGAACTGGGTCCGCCAGGCTCCAGGAAAGGGTTTGGAATGGGTTGCTCGCA<br>TAAGAAGTAAATATAATAATTATGCAACATATTATGCCGATTCAGTGAAAGACAGGTTCACCATC |

| SEQ ID NO. | DESIGNATION | SOURCE | TYPE | SEQUENCE |
|---|---|---|---|---|
| | | | | TCCAGAGATGATTCAAAAAACACTGCCTATCTACAAATGAACAACTTGAAAACTGAGGACACTGC CGTGTACTACTGTGTGAGACATGGGAACTTCGGTAATAGCTACATATCCTACTGGGCTTACTGGG GCCAAGGGACTCTGGTCACCGTCTCCTCAGGTGGTGGTGGTTCTGGCGGCGGCGGCTCCGGTGGT GGTGGTTCTCAGACTGTTGTGACTCAGGAACCTTCACTCACCGTATCACCTGGTGGAACAGTCAC ACTCACTTGTGGCCTCTCGACTGGGGCTGTTACATCTGGCAACTACCCAAACTGGGTCCAACAAA AACCAGGTCAGGCACCCCGTGGTCTAATAGGTGGGACTAAGTTCCTCGCCCCCGGTACTCCTGCC AGATTCTCAGGCTCCCTGCTTGGAGGCAAGGCTGCCCTCACCCTCTCAGGGGTACAGCCAGAGGA TGAGGCAGAATATTACTGTGTTCTATGGTACAGCAACCGCTGGGTGTTCGGTGGAGGAACCAAAC TGACTGTCCTA |
| 569. ME62A4-H | artificial | aa | | QVQLVQSGAEVMKPGASVKVSCRASGYTFTSYWLHWVRQAPGQGLEWIGMIDPSNSDTRFNPNFK DRVTMTVDTSSSTAYMELSSLRSEDTAVYYCATYGSYVSPLDYWGQGTSVTVSS |
| 570. ME62A4-HCDR1 | artificial | aa | | SYWLH |
| 571. ME62A4-HCDR2 | artificial | aa | | MIDPSNSDTRFNPNFKD |
| 572. ME62A4-HCDR3 | artificial | aa | | YGSYVSPLDY |
| 573. ME62A4-H | artificial | nt | | CAGGTGCAGCTGGTCCAGTCTGGGGCTGAAGTGATGAAGCCTGGGGCTTCAGTGAAAGTGTCCTG CAGGGCTTCGGGCTATACCTTCACCAGCTACTGGTTGCACTGGGTTAGACAGGCGCCTGGACAAG GCTTGAGTGGATAGGCATGATTGATCCTTCCAATAGTGACACTAGGTTTAATCCGAACTTCAAG GACAGGGTCACAATGACTGTAGACACATCTTCCAGCACAGCCTACATGGAGCTCAGCAGCCTGAG ATCTGAGGACACTGCAGTCTATTACTGTGCCACATATGGTAGCTACGTTTCCCCTCTGGACTACT GGGGTCAAGGAACCTCGGTCACCGTCTCCTCA |
| 574. ME62A4-L | artificial | aa | | DIVMTQTPFSLPVTAGETVSISCKSSQSLLYTSSQKNYLAWYLQKPGQSPQLLIYWASTRESGVP DRFSGSGSGTDFTLKISRVEAEDVGVYYCQQYYAYPWTFGGGTKLEIK |
| 575. ME62A4-LCDR1 | artificial | aa | | KSSQSLLYTSSQKNYLA |
| 576. ME62A4-LCDR2 | artificial | aa | | WASTRES |
| 577. ME62A4-LCDR3 | artificial | aa | | QQYYAYPWT |
| 578. ME62A4-L | artificial | nt | | GACATCGTGATGACCCAGACTCCATTCTCCCTACCTGTGACAGCTGGAGAGACGGTTTCTATCAG CTGCAAGTCCAGTCAGTCCCTTTTATATACTAGCAGTCAGAAGAACTACTTGGCCTGGTACCTGC AGAAACCAGGTCAGTCTCCTCAACTGCTGATTTACTGGGCATCCACTAGGGAATCTGGGGTCCCT GATCGCTTCTCAGGCAGTGGATCTGGGACAGATTTCACTCTCAAAATCTCCAGAGTGGAGGCTGA GGACGTGGGAGTTTATTACTGTCAGCAATATTATGCCTATCCGTGGACGTTCGGTGGAGGCACAA AGTTGGAGATCAAA |
| 579. ME62A4-HL | artificial | aa | | QVQLVQSGAEVMKPGASVKVSCRASGYTFTSYWLHWVRQAPGQGLEWIGMIDPSNSDTRFNPNFK DRVTMTVDTSSSTAYMELSSLRSEDTAVYYCATYGSYVSPLDYWGQGTSVTVSSGGGGSGGGGSG GGGSDIVMTQTPFSLPVTAGETVSISCKSSQSLLYTSSQKNYLAWYLQKPGQSPQLLIYWASTRE SGVPDRFSGSGSGTDFTLKISRVEAEDVGVYYCQQYYAYPWTFGGGTKLEIK |
| 580. ME62A4-HL | artificial | nt | | CAGGTGCAGCTGGTCCAGTCTGGGGCTGAAGTGATGAAGCCTGGGGCTTCAGTGAAAGTGTCCTG CAGGGCTTCGGGCTATACCTTCACCAGCTACTGGTTGCACTGGGTTAGACAGGCGCCTGGACAAG GCTTGAGTGGATAGGCATGATTGATCCTTCCAATAGTGACACTAGGTTTAATCCGAACTTCAAG GACAGGGTCACAATGACTGTAGACACATCTTCCAGCACAGCCTACATGGAGCTCAGCAGCCTGAG ATCTGAGGACACTGCAGTCTATTACTGTGCCACATATGGTAGCTACGTTTCCCCTCTGGACTACT GGGGTCAAGGAACCTCGGTCACCGTCTCCTCAGGTGGTGGTGGTTCTGGCGGCGGCGGCTCCGGT GGTGGTGGTTCTGACATCGTGATGACCCAGACTCCATTCTCCCTACCTGTGACAGCTGGAGAGAC GGTTTCTATCAGCTGCAAGTCCAGTCAGTCCCTTTTATATACTAGCAGTCAGAAGAACTACTTGG CCTGGTACCTGCAGAAACCAGGTCAGTCTCCTCAACTGCTGATTTACTGGGCATCCACTAGGGAA TCTGGGGTCCCTGATCGCTTCTCAGGCAGTGGATCTGGGACAGATTTCACTCTCAAAATCTCCAG AGTGGAGGCTGAGGACGTGGGAGTTTATTACTGTCAGCAATATTATGCCTATCCGTGGACGTTCG GTGGAGGCACAAAGTTGGAGATCAAA |
| 581. ME62A4 HL x I2C HL | artificial | aa | | QVQLVQSGAEVMKPGASVKVSCRASGYTFTSYWLHWVRQAPGQGLEWIGMIDPSNSDTRFNPNFK DRVTMTVDTSSSTAYMELSSLRSEDTAVYYCATYGSYVSPLDYWGQGTSVTVSSGGGGSGGGGSG GGGSDIVMTQTPFSLPVTAGETVSISCKSSQSLLYTSSQKNYLAWYLQKPGQSPQLLIYWASTRE SGVPDRFSGSGSGTDFTLKISRVEAEDVGVYYCQQYYAYPWTFGGGTKLEIKSGGGGSEVQLVES GGGLVQPGGSLKLSCAASGFTFNKYAMNWVRQAPGKGLEWVARIRSKYNNYATYYADSVKDRFTI SRDDSKNTAYLQMNNLKTEDTAVYYCVRHGNFGNSYISYWAYWGQGTLVTVSSGGGGSGGGGSGG GGSQTVVTQEPSLTVSPGGTVTLTCGSSTGAVTSGNYPNWVQQKPGQAPRGLIGGTKFLAPGTPA RFSGSLLGGKAALTLSGVQPEDEAEYYCVLWYSNRWVFGGGTKLTVL |
| 582. ME62A4 HL x I2C HL | artificial | nt | | CAGGTGCAGCTGGTCCAGTCTGGGGCTGAAGTGATGAAGCCTGGGGCTTCAGTGAAAGTGTCCTG CAGGGCTTCGGGCTATACCTTCACCAGCTACTGGTTGCACTGGGTTAGACAGGCGCCTGGACAAG GCTTGAGTGGATAGGCATGATTGATCCTTCCAATAGTGACACTAGGTTTAATCCGAACTTCAAG GACAGGGTCACAATGACTGTAGACACATCTTCCAGCACAGCCTACATGGAGCTCAGCAGCCTGAG ATCTGAGGACACTGCAGTCTATTACTGTGCCACATATGGTAGCTACGTTTCCCCTCTGGACTACT GGGGTCAAGGAACCTCGGTCACCGTCTCCTCAGGTGGTGGTGGTTCTGGCGGCGGCGGCTCCGGT |

| SEQ ID NO. | DESIGNATION | SOURCE | TYPE | SEQUENCE |
|---|---|---|---|---|
| | | | | GGTGGTGGTTCTGACATCGTGATGACCCAGACTCCATTCTCCCTACCTGTGACAGCTGGAGAGAC GGTTTCTATCAGCTGCAAGTCCAGTCAGTCCCTTTTATATACTAGCAGTCAGAAGAACTACTTGG CCTGGTACCTGCAGAAACAGGTCAGTCTCCTCAACTGCTGATTTACTGGGCATCCACTAGGGAA TCTGGGGTCCCTGATCGCTTCTCAGGCAGTGGATCTGGGACAGATTTCACTCTCAAAATCTCCAG AGTGGAGGCTGAGGACGTGGGAGTTTATTACTGTCAGCAATATTATGCCTATCCGTGGACGTTCG GTGGAGGCACAAAGTTGGAGATCAAATCCGGAGGTGGTGGATCCGAGGTGCAGCTGGTCGAGTCT GGAGGAGGATTGGTGCAGCCTGGAGGGTCATTGAAACTCTCATGTGCAGCCTCTGGATTCACCTT CAATAAGTACGCCATGAACTGGGTCCGCCAGGCTCCAGGAAAGGGTTTGGAATGGGTTGCTCGCA TAAGAAGTAAAATAATAATTAGTGGTGATGGAAGTACCTATTATAGAGATTCAGTGAAAGACAGGTT CACCATCTCCAGAGATGATTCAAAAAACACTGCCTATCTACAAATGAACAACTTGAAAACTGAGGA CACTGCCGTGTACTACTGTGTGAGACATGGGAACTTCGGTAATAGCTACATATCCTACTGGGCTTA CTGGGGCCAAGGGACTCTGGTCACCGTCTCCTCAGGTGGTGGTGGTTCTGGCGGCGGCGGCTCCGG TGGTGGTGGTTCTCAGACTGTTGTGACTCAGGAACCTTCACTCACCGTATCCCTGGTGGAACAGTCAC ACTCCACTTGTGGCTCCTCGACTGGGGCTGTTACATCTGGCAACTACCCAAACTGGGTCCAACAAA AACCAGGTCAGGCACCCCGTGGTCTAATAGGTGGGACTAAGTTCCTCGCCCCCGGTACTCCTGCC AGATTCTCAGGCTCCCTGCTTGGAGGCAAGGCTGCCCTCACCCTCTCAGGGGTACAGCCAGAGGA TGAGGCAGAATATTACTGTGTTCTATGGTACAGCAACCGCTGGGTGTTCGGTGGAGGAACCAAAC TGACTGTCCTA |
| 583. | ME75H6-H | murine | aa | EVQLLEQSGAELVRPGTSVKMSCKAAGYTFTKYWIGWVKQRPGHGLEWIGDIHPGGGYANYNEKF KGKATLTADTSSSTAYMQLSRLTSDDSAIYYCARSGYDYGSSYDYHGMDFWGQGTTVTVSS |
| 584. | ME75H6-HCDR1 | murine | aa | KYWIG |
| 585. | ME75H6-HCDR2 | murine | aa | DIHPGGGYANYNEKFKG |
| 586. | ME75H6-HCDR3 | murine | aa | SGYDYGSSYDYHGMDF |
| 587. | ME75H6-H | murine | nt | GAGGTGCAGCTGCTCGAGCAGTCTGGAGCTGAGCTGGTTAGGCCTGGGACTTCAGTGAAGATGTC CTGCAAGGCTGCTGGATACACCTTCACTAAGTACTGGATAGGTTGGGTAAAGCAGAGGCCTGGAC ATGGCCTTGAGTGGATTGGAGATATTCACCCTGGAGGTGGTTATGCTAACTACAATGAGAAGTTC AAGGGCAAGGCCACACTGACTGCAGACACATCCTCCAGCACAGCCTACATGCAGCTCAGCAGACT GACATCTGATGACTCCGCCATCTATTACTGTGCAAGATCGGGGTATGACTACGGTAGTAGTTACG ATTACCATGGTATGGACTTCTGGGGCCAAGGGACCACGGTCACCGTCTCCTCA |
| 588. | ME75H6-L | murine | aa | ELQMTQSPASLSASVGEPVTFTCRASENIYSYLAWYQQKQGKSPQLLIYGATNLADGMSSRFSGS GSGRQYSLKISSLHPDDVATYYCQNVLSTPYTFGGGTKLEIK |
| 589. | ME75H6-LCDR1 | murine | aa | RASENIYSYLA |
| 590. | ME75H6-LCDR2 | murine | aa | GATNLAD |
| 591. | ME75H6-LCDR3 | murine | aa | QNVLSTPYT |
| 592. | ME75H6-L | murine | nt | GAGCTCCAGATGACCCAGTCTCCAGCCTCCCTATCTGCATCTGTGGGAGAACCTGTCACCTTCAC ATGTCGAGCAAGTGAGAATATTTACAGTTATTTAGCATGGTATCAGCAGAAACAGGGAAAATCTC CTCAGCTCCTGATCTATGGTGCAACCAACTTGGCAGATGGCATGTCATCGAGGTTCAGTGGCAGT GGATCTGGTAGACAGTATTCTCTCAAGATCAGTAGCCTGCATCCTGACGATGTTGCAACGTATTA CTGTCAAAATGTGTTAAGTACTCCGTACACGTTCGGAGGGGGGACCAAGCTTGAGATCAAA |
| 593. | ME75H6-HL | murine | aa | EVQLLEQSGAELVRPGTSVKMSCKAAGYTFTKYWIGWVKQRPGHGLEWIGDIHPGGGYANYNEKF KGKATLTADTSSSTAYMQLSRLTSDDSAIYYCARSGYDYGSSYDYHGMDFWGQGTTVTVSSGGGG SGGGGSGGGGSELQMTQSPASLSASVGEPVTFTCRASENIYSYLAWYQQKQGKSPQLLIYGATNL ADGMSSRFSGSGSGRQYSLKISSLHPDDVATYYCQNVLSTPYTFGGGTKLEIK |
| 594. | ME75H6-HL | murine | nt | GAGGTGCAGCTGCTCGAGCAGTCTGGAGCTGAGCTGGTTAGGCCTGGGACTTCAGTGAAGATGTC CTGCAAGGCTGCTGGATACACCTTCACTAAGTACTGGATAGGTTGGGTAAAGCAGAGGCCTGGAC ATGGCCTTGAGTGGATTGGAGATATTCACCCTGGAGGTGGTTATGCTAACTACAATGAGAAGTTC AAGGGCAAGGCCACACTGACTGCAGACACATCCTCCAGCACAGCCTACATGCAGCTCAGCAGACT GACATCTGATGACTCCGCCATCTATTACTGTGCAAGATCGGGGTATGACTACGGTAGTAGTTACG ATTACCATGGTATGGACTTCTGGGGCCAAGGGACCACGGTCACCGTCTCCTCAGGTGGTGGTGGT TCTGGCGGCGGCGGCTCCGGTGGTGGTGGTTCTGAGCTCCAGATGACCCAGTCTCCAGCCTCCCT ATCTGCATCTGTGGGAGAACCTGTCACCTTCACATGTCGAGCAAGTGAGAATATTTACAGTTATT TAGCATGGTATCAGCAGAAACAGGGAAAATCTCCTCAGCTCCTGATCTATGGTGCAACCAACTTG GCAGATGGCATGTCATCGAGGTTCAGTGGCAGTGGATCTGGTAGACAGTATTCTCTCAAGATCAG TAGCCTGCATCCTGACGATGTTGCAACGTATTACTGTCAAAATGTGTTAAGTACTCCGTACACGT TCGGAGGGGGGACCAAGCTTGAGATCAAA |
| 595. | ME75H6 HL x I2C HL | murine | aa | EVQLLEQSGAELVRPGTSVKMSCKAAGYTFTKYWIGWVKQRPGHGLEWIGDIHPGGGYANYNEKF KGKATLTADTSSSTAYMQLSRLTSDDSAIYYCARSGYDYGSSYDYHGMDFWGQGTTVTVSSGGGG SGGGGSGGGGSELQMTQSPASLSASVGEPVTFTCRASENIYSYLAWYQQKQGKSPQLLIYGATNL ADGMSSRFSGSGSGRQYSLKISSLHPDDVATYYCQNVLSTPYTFGGGTKLEIKSGGGGSEVQLVE SGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSG |

| SEQ ID NO. | DESIGNATION | SOURCE | TYPE | SEQUENCE |
|---|---|---|---|---|
| | | | | GGGSQTVVTQEPSLTVSPGGTVTLTCGSSTGAVTSGNYPNWVQQKPGQAPRGLIGGTKFLAPGTP ARFSGSLLGGKAALTLSGVQPEDEAEYYCVLWYSNRWVFGGGTKLTVL |
| 596. | ME75H6 HL x I2C HL | murine | nt | GAGGTGCAGCTGCTCGAGCAGTCTGGAGCTGAGCTGGTTAGGCCTGGGACTTCAGTGAAGATGTC CTGCAAGGCTGCTGGATACACCTTCACTAAGTACTGGATAGGTTGGGTAAAGCAGAGGCCTGGAC ATGGCCTTGAGTGGATTGGAGATATTCACCCTGGAGGTGGTTATGCTAACTACAATGAGAAGTTC AAGGGCAAGGCCACACTGACTGCAGACACATCCTCCAGCACAGCCTACATGCAGCTCAGCAGACT GACATCTGATGACTCCGCCATCTATTACTGTGCAAGATCGGGGTATGACTACGGTAGTAGTTACG ATTACCATGGTATGGACTTCTGGGGCCAAGGGACCCACGGTCACCGTCTCCTCAGGTGGTGGTGGT TCTGGCGGCGGCGGCTCCGGTGGTGGTGGTTCTGAGCTCCAGATGACCCAGTCTCCAGCCTCCCT ATCTGCATCTGTGGGAGAACCTGTCACCTTCACATGTCGAGCAAGTGAGAATATTTACAGTTATT TAGCATGGTATCAGCAGAAACAGGGAAAATCTCCTCAGCTCCTGATCTATGGTGCAACCAACTTG GCAGATGGCATGTCATCGAGGTTCAGTGGCAGTGGATCTGGTAGACAGTATTCTCTCAAGATCAG TAGCCTGCATCCTGACGATGTTGCAACGTATTACTGTCAAAATGTGTTAAGTACTCCGTACACGT TCGGAGGGGGGACCAAGCTTGAGATCAAATCCGGAGGTGGTGGATCCGAGGTGCAGCTGGTCGAG TCTGGAGGAGGATTGGTGCAGCCTGGAGGGTCATTGAAACTCTCATGTGCAGCCTCTGGATTCAC CTTCAATAAGTACGCCATGAACTGGGTCCGCCAGGCTCCAGGAAAGGGTTTGGAATGGGTTGCTC GCATAAGAAGTAAATATAATAATTATGCAACATATTATGCCGATTCAGTGAAAGACAGGTTCACC ATCTCCAGAGATGATTCAAAAAACACTGCCTATCTACAAATGAACAACTTGAAAACTGAGGACAC TGCCGTGTACTACTGTGTGAGACATGGGAACTTCGGTAATAGCTACATATCCTACTGGGCTTACT GGGGCCAAGGGACTCTGGTCACCGTCTCCTCAGGTGGTGGTGGTTCTGGCGGCGGCGGCTCCGGT GGTGGTGGTTCTCAGACTGTTGTGACTCAGGAACCTTCACTCACCGTATCCTGTGGTGACAGT CACACTCACTTGTGGCTCCTCGACTGGGGCTGTTACATCTGGCAACTACCCAAACTGGGTCCAAC AAAAACCAGGTCAGGCACCCCGTGGTCTAATAGGTGGGACTAAGTTCCTCGCCCCCGGTACTCCT GCCAGATTCTCAGGCTCCCTGCTTGGAGGCAAGGCTGCCCTCACCCTCTCAGGGGTACAGCCAGA GGATGAGGCAGAATATTACTGTGTTCTATGGTACAGCAACCGCTGGGTGTTCGGTGGAGGAACCA AACTGACTGTCCTA |
| 597. | ME99B1-H | murine | aa | EVQLLEQSGAELVRPGTSVKISCKATGYTFSNYWISWVKYRPGHGLEWIGDIYPGGSYTNYNEKF KGKVTLTADTSSRTAYMQLSGLTFEDSAIYYCARSGYDYGSDYDYHGMDYWGQGTTVTVSSG |
| 598. | ME99B1-HCDR1 | murine | aa | NYWIS |
| 599. | ME99B1-HCDR2 | murine | aa | DIYPGGSYTNYNEKFKG |
| 600. | ME99B1-HCDR3 | murine | aa | SGYDYGSDYDYHGMDY |
| 601. | ME99B1-H | murine | nt | GAGGTGCAGCTGCTCGAGCAGTCTGGAGCTGAGCTGGTAAGGCCTGGGACTTCAGTGAAGATTTC CTGCAAGGCTACTGGGTACACCTTCAGTAATTACTGGATAAGTTGGGTAAAGTATAGGCCTGGAC ATGGTCTTGAGTGGATTGGAGATATTTACCCTGGAGGCAGTTATACTAATTACAATGAGAAATTC AAGGGCAAGGTCACACTGACTGCAGACACATCCTCCAGGACAGCCTACATGCAGCTCAGCGGCCT GACATTTGAGGACTCTGCCATCTACTACTGTGCAAGATCGGGGTATGACTACGGTAGTGACTACG ATTACCATGGTATGGACTACTGGGGCCAAGGGACCACGGTCACCGTCTCCTCA |
| 602. | ME99B1-L | murine | aa | ELQMTQSPASLSASVGETVTITCRASENIYSNLAWYQQKQGKSPQLLVYAATNLADGVPSRFSGS RSGSDYSLTISSLESEDFVDYYCLQYASYPYTFGGGTKLEIK |
| 603. | ME99B1-LCDR1 | murine | aa | RASENIYSNLA |
| 604. | ME99B1-LCDR2 | murine | aa | AATNLAD |
| 605. | ME99B1-LCDR3 | murine | aa | LQYASYPYT |
| 606. | ME99B1-L | murine | nt | GAGCTCCAGATGACCCAGTCTCCAGCCTCCCTATCTGCATCTGTGGGAGAAACTGTCACCATCAC ATGTCGAGCAAGTGAGAATATTTACAGTAATTTAGCATGGTATCAGCAGAAACAGGGAAAATCTC CTCAGCTCCTGGTCTATGCTGCAACAAACTTAGCAGATGGTGTGCCATCAAGGTTCAGTGGCAGT AGGTCTGGGTCAGATTATTCTCTCACCATCAGCAGCCTTGAGTCTGAAGATTTTGTAGACTATTA CTGTCTACAATATGCTAGTTATCCGTACACGTTCGGAGGGGGGACCAAGCTTGAGATCAAA |
| 607. | ME99B1-HL | murine | aa | EVQLLEQSGAELVRPGTSVKISCKATGYTFSNYWISWVKYRPGHGLEWIGDIYPGGSYTNYNEKF KGKVTLTADTSSRTAYMQLSGLTFEDSAIYYCARSGYDYGSDYDYHGMDYWGQGTTVTVSSGGGG SGGGGSGGGGSELQMTQSPASLSASVGETVTITCRASENIYSNLAWYQQKQGKSPQLLVYAATNL ADGVPSRFSGSRSGSDYSLTISSLESEDEVDYYCLQYASYPYTFGGGTKLEIK |
| 608. | ME99B1-HL | murine | nt | GAGGTGCAGCTGCTCGAGCAGTCTGGAGCTGAGCTGGTAAGGCCTGGGACTTCAGTGAAGATTTC CTGCAAGGCTACTGGGTACACCTTCAGTAATTACTGGATAAGTTGGGTAAAGTATAGGCCTGGAC ATGGTCTTGAGTGGATTGGAGATATTTACCCTGGAGGCAGTTATACTAATTACAATGAGAAATTC AAGGGCAAGGTCACACTGACTGCAGACACATCCTCCAGGACAGCCTACATGCAGCTCAGCGGCCT GACATTTGAGGACTCTGCCATCTACTACTGTGCAAGATCGGGGTATGACTACGGTAGTGACTACG ATTACCATGGTATGGACTACTGGGGCCAAGGGACCACGGTCACCGTCTCCTCAGGTGGTGGTGGT TCTGGCGGCGGCGGCTCCGGTGGTGGTGGTTCTGAGCTCCAGATGACCCAGTCTCCAGCCTCCCT ATCTGCATCTGTGGGAGAAACTGTCACCATCACATGTCGAGCAAGTGAGAATATTTACAGTAATT TAGCATGGTATCAGCAGAAACAGGGAAAATCTCCTCAGCTCCTGGTCTATGCTGCAACAAACTTA GCAGATGGTGTGCCATCAAGGTTCAGTGGCAGTAGGTCTGGGTCAGATTATTCTCTCACCATCAG |

| SEQ ID NO. | DESIGNATION | SOURCE | TYPE | SEQUENCE |
|---|---|---|---|---|
| | | | | CAGCCTTGAGTCTGAAGATTTTGTAGACTATTACTGTCTACAATATGCTAGTTATCCGTACACGT<br>TCGGAGGGGGGACCAAGCTTGAGATCAAA |
| 609. | ME99B1 HL x I2C HL | murine | aa | EVQLLEQSGAELVRPGTSVKISCKATGYTFSNYWISWVKYRPGHGLEWIGDIYPGGSYTNYNEKF<br>KGKVTLTADTSSRTAYMQLSGLTFEDSAIYYCARSGYDYGSDYDYHGMDYWGQGTTVTVSSGGGG<br>SGGGGSGGGGSELQMTQSPASLSASVGETVTITCRASENIYSNLAWYQQKQGKSPQLLVYAATNL<br>ADGVPSRFSGSRSGSDYSLTISSLESEDFVDYYCLQYASYPYTFGGGTKLEIKSGGGGSEVQLVE<br>SGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSG<br>GGGSQTVVTQEPSLTVSPGGTVTLTCGSSTGAVTSGNYPNWVQQKPGQAPRGLIGGTKFLAPGTP<br>ARFSGSLLGGKAALTLSGVQPEDEAEYYCVLWYSNRWVFGGGTKLTVL |
| 610. | ME99B1 HL x I2C HL | murine | nt | GAGGTGCAGCTGCTCGAGCAGTCTGGAGCTGAGCTGGTAAGGCCTGGGACTTCAGTGAAGATTTC<br>CTGCAAGGCTACTGGGTACACCTTCAGTAATTACTGGATAAGTTGGGTAAAGTATAGGCCTGGAC<br>ATGGTCTTGAGTGGATTGGAGATATTTACCCTGGAGGCAGTTATACTAATTACAATGAGAAATTC<br>AAGGGCAAGGTCACACTGACTGCAGACACATCCTCCAGGACAGCCTACATGCAGCTCAGCGGCCT<br>GACATTTGAGGACTCTGCCATCTACTACTGTGCAAGATCGGGGTATGACTACGGTAGTGACTACG<br>ATTACATGGATATGGACTACTGGGGTCAAGGGACCACGGTCACCGTCTCCTCAGGTGGTGGTGGT<br>TCTGGCGGCGGCGGCTCCGGTGGTGGTGGTTCTGAGCTCCAGATGACCCAGTCTCCAGCCTCCCT<br>ATCTGCATCTGTGGGAGAAACTGTCACCATCACATGTCGAGCAAGTGAGAATATTTACAGTAATT<br>TAGCATGGTATCAGCAGAAACAGGGAAAATCTCCTCAGCTCCTGGTCTATGCTGCAACAAACTTA<br>GCAGATGGTGTGCCATCAAGGTTCAGTGGCAGTAGGTCTGGGTCAGATTATTCTCTCACCATCAG<br>CAGCCTTGAGTCTGAAGATTTTGTAGACTATTACTGTCTACAATATGCTAGTTATCCGTACACGT<br>TCGGAGGGGGGACCAAGCTTGAGATCAAATCCGGAGGTGGTGGATCGGAGGTGCAGCTGGTCGAG<br>TCTGGAGGAGGATTGGTGCAGCCTGGAGGGTCATTGAAACTCTCATGTGCAGCCTCTGGATTCAC<br>CTTCAATAAGTACGCCATGAACTGGGTCCGCCAGGCTCCAGGAAAGGGTTTGGAATGGGTTGCTC<br>GCATAAGAAGTAAATATAATAATTATGCAACATATTATGCCGATTCAGTGAAAGACAGGTTCACC<br>ATCTCCAGAGATGATTCAAAAAACACTGCCTATCTACAAATGAACAACTTGAAAACTGAGGACAC<br>TGCCGTGTACTACTGTGTGAGACATGGGAACTTCGGTAATAGCTACATATCCTACTGGGCTTACT<br>GGGGCCAAGGGACTCTGGTCACCGTCTCCTCAGGTGGTGGTGGTTCTGGCGGCGGCGGCTCCGGT<br>GGTGGTGGTTCTCAGACTGTTGTGACTCAGGAACCTTCACTCACCGTATCACCTGGTGGAACAGT<br>CACACTCACTTGTGGCCTCCTGACTGGGGCTGTTACATCTGGCAACTACCCAAACTGGGTCCAAC<br>AAAAACCAGGTCAGGCACCCCGTGGTCTAATAGGTGGGACTAAGTTCCTCGCCCCCGGTACTCCT<br>GCCAGATTCTCAGGCTCTCCTCGCTTGGAGGCAAGGCTGCCCTCACCCTCTCAGGGGTACAGCCAGA<br>GGATGAGGCAGAATATTACTGTGTTCTATGGTACAGCAACCGCTGGGTGTTCGGTGGAGGAACCA<br>AACTGACTGTCCTA |
| 611. | ME05B7-H | murine | aa | EVQLLEQSGAELVRPGTSVKISCKTTGYTFGYYWISWLKQRPGHGLEWIGDIYPGGGYTNYHEKF<br>KGKVTLTADTSSRTAYMQLSSLTFEDSAIYYCARSGYDYGSDYDYHGMDYWGQGTTVTVSS |
| 612. | ME05B7-HCDR1 | murine | aa | YYWIS |
| 613. | ME05B7-HCDR2 | murine | aa | DIYPGGGYTNYHEKFKG |
| 614. | ME05B7-HCDR3 | murine | aa | SGYDYGSDYDYHGMDY |
| 615. | ME05B7-H | murine | nt | GAGGTGCAGCTGCTCGAGCAGTCTGGAGCTGAGCTGGTTAGGCCTGGGACTTCAGTGAAGATTTC<br>CTGCAAGACTACTGGGTACACCTTCGGTTATTACTGGATAAGTTGGTTAAAGCAGAGGCCTGGAC<br>ATGGCCTTGAGTGGATTGGAGATATTTACCCTGGAGGTGGTTACACTAACTACCATGAGAAATTC<br>AAGGGCAAGGTCACACTGACTGCAGACACATCCTCCAGGACAGCCTACATGCAGCTCAGCAGCCT<br>GACATTTGAGGACTCTGCCATCTATTACTGTGCAAGATCGGGATATGACTACGGTAGTGACTACG<br>ATTATCATGGTATGGATTACTGGGGCCAAGGGACCACGGTCACCGTCTCCTCA |
| 616. | ME05B7-L | murine | aa | ELVMTQTPSSLSASLGDRVTISCRASQGISNYLNWYQQKPDGSVKLLIYYTSRLHSGVPSRFSGS<br>GSGTDYSLTISNLDQEDIATYFCQQGNTLPWTFGGGTKLEIK |
| 617. | ME05B7-LCDR1 | murine | aa | RASQGISNYLN |
| 618. | ME05B7-LCDR2 | murine | aa | YTSRLHS |
| 619. | ME05B7-LCDR3 | murine | aa | QQGNTLP |
| 620. | ME05B7-L | murine | nt | GAGCTCGTGATGACCCAGACTCCATCCTCCCTGTCTGCCTCTCTGGGAGACAGAGTCACCATCAG<br>TTGCAGGGCAAGTCAGGGCATTAGCAATTATTTAAACTGGTATCAGCAGAAACCAGATGGATCT<br>GTTAAACTCCTGATCTACTACACATCAAGATTACACTCAGGAGTCCCATCAAGGTTCAGTGGCAGT<br>GGGTCTGGAACAGATTATTCTCTCACCATTAGCAACCTGGATCAAGAAGATATTGCCACTTACTT<br>TTGCCAACAGGGTAATACGCTTCCGTGGACGTTCGGAGGGGGGACCAAGCTTGAGATCAAA |
| 621. | ME05B7-HL | murine | aa | EVQLLEQSGAELVRPGTSVKISCKTTGYTFGYYWISWLKQRPGHGLEWIGDIYPGGGYTNYHEKF<br>KGKVTLTADTSSRTAYMQLSSLTFEDSAIYYCARSGYDYGSDYDYHGMDYWGQGTTVTVSSGGGG<br>SGGGGSGGGGSELVMTQTPSSLSASLGDRVTISCRASQGISNYLNWYQQKPDGSVKLLIYYTSRL<br>HSGVPSRFSGSGSGTDYSLTISNLDQEDIATYFCQQGNTLPWTFGGGTKLEIK |
| 622. | ME05B7-HL | murine | nt | GAGGTGCAGCTGCTCGAGCAGTCTGGAGCTGAGCTGGTTAGGCCTGGGACTTCAGTGAAGATTTC<br>CTGCAAGACTACTGGGTACACCTTCGGTTATTACTGGATAAGTTGGTTAAAGCAGAGGCCTGGAC |

| SEQ ID NO. | DESIGNATION | SOURCE | TYPE | SEQUENCE |
|---|---|---|---|---|
| | | | | ATGGCCTTGAGTGGATTGGAGATATTTACCCTGGAGGTGGTTACACTAACTACCATGAGAAATTC<br>AAGGGCAAGGTCACACTGACTGCAGACACATCCTCCAGGACAGCCTACATGCAGCTCAGCAGCCT<br>GACATTTGAGGACTCTGCCATCTATTACTGTGCAAGATCGGGATATGACTACGGTAGTGACTACG<br>ATTATCATGGTATGGATTACTGGGGCCAAGGGACCACGGTCACCGTCTCCTCAGGTGGTGGTGGT<br>TCTGGCGGCGGCGGCTCCGGTGGTGGTGGTTCTGAGCTCGTGATGACCCAGACTCCATCCTCCCT<br>GTCTGCCTCTCTGGGAGACAGAGTCACCATCAGTTGCAGGGCAAGTCAGGGCATTAGCAATTATT<br>TAAACTGGTATCAGCAGAAACCAGATGGATCTGTTAAACTCCTGATCTACTACACATCAAGATTA<br>CACTCAGGAGTCCCATCAAGGTTCAGTGGCAGTGGGTCTGGAACAGATTATTCTCTCACCATTAG<br>CAACCTGGATCAAGAAGATATTGCCACTTACTTTTGCCAACAGGGTAATACGCTTCCGTGGACGT<br>TCGGAGGGGGGACCAAGCTTGAGATCAAA |
| 623. | ME05B7 HL x I2C HL | murine | aa | EVQLLEQSGAELVRPGTSVKISCKTTGYTFGYYWISWLKQRPGHGLEWIGDIYPGGGYTNYHEKF<br>KGKVTLTADTSSRTAYMQLSSLTFEDSAIYYCARSGYDYGSDYDHGMDYWGQGTTVTVSSGGGG<br>SGGGGSGGGGSELVMTQTPSSLSASLGDRVTISCRASQGISNYLNWYQQKPDGSVKLLIYYTSRL<br>HSGVPSRFSGSGSGTDYSLTISNLDQEDIATYFCQQGNTLPWTFGGGTKLEIKSGGGGSEVQLVE<br>SGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSG<br>GGGSQTVVTQEPSLTVSPGGTVTLTCGSSTGAVTSGNYPNWVQQKPGQAPRGLIGGTKFLAPGTP<br>ARFSGSLLGGKAALTLSGVQPEDEAEYYCVLWYSNRWVFGGGTKLTVL |
| 624. | ME05B7 HL x I2C HL | murine | nt | GAGGTGCAGCTGCTCGAGCAGTCTGGAGCTGAGCTGGTTAGGCCTGGGACTTCAGTGAAGATTTC<br>CTGCAAGACTACTGGGTACACCTTCGGTTATTACTGGATAAGTTGGTTAAAGCAGAGGCCTGGAC<br>ATGGCCTTGAGTGGATTGGAGATATTTACCCTGGAGGTGGTTACACTAACTACCATGAGAAATTC<br>AAGGGCAAGGTCACACTGACTGCAGACACATCCTCCAGGACAGCCTACATGCAGCTCAGCAGCCT<br>GACATTTGAGGACTCTGCCATCTATTACTGTGCAAGATCGGGATATGACTACGGTAGTGACTACG<br>ATTATCATGGTATGGATTACTGGGGCCAAGGGACCACGGTCACCGTCTCCTCAGGTGGTGGTGGT<br>TCTGGCGGCGGCGGCTCCGGTGGTGGTGGTTCTGAGCTCGTGATGACCCAGACTCCATCCTCCCT<br>GTCTGCCTCTCTGGGAGACAGAGTCACCATCAGTTGCAGGGCAAGTCAGGGCATTAGCAATTATT<br>TAAACTGGTATCAGCAGAAACCAGATGGATCTGTTAAACTCCTGATCTACTACACATCAAGATTA<br>CACTCAGGAGTCCCATCAAGGTTCAGTGGCAGTGGGTCTGGAACAGATTATTCTCTCACCATTAG<br>CAACCTGGATCAAGAAGATATTGCCACTTACTTTTGCCAACAGGGTAATACGCTTCCGTGGACGT<br>TCGGAGGGGGGACCAAGCTTGAGATCAAATCCGGAGGTGGTGGATCCGAGGTGCAGCTGGTCGAG<br>TCTGGAGGAGGATTGGTGCAGCCTGGAGGGTCATTGAAACTCTCATGTGCAGCCTCTGGATTCAC<br>CTTCAATAAGTACGCCATGAACTGGGTCCGCCAGGCTCCAGGAAAGGGTTTGGAATGGGTTGCTC<br>GCATAAGAAGTAAATATAATAATTATGCAACATATTATGCCGATTCAGTGAAAGACAGGTTCACC<br>ATCTCCAGAGATGATTCAAAAAACACTGCCTATCTACAAATGAACAACTTGAAAACTGAGGACAC<br>TGCCGTGTACTACTGTGTGAGACATGGGAACTTCGGTAATAGCTACATATCCTACTGGGCTTACT<br>GGGGCCAAGGGACTCTGGTCACCGTCTCCTCAGGTGGTGGTGGTTCTGGCGGCGGCGGCTCCGGT<br>GGTGGTGGTTCTCAGACTGTTGTGACTCAGGAACCTTCACTCACCGTATCACCTGGAGAACAGT<br>CACACTCACTTGTGGCTCCTGACTGGGGCTGTTACATCTGGCAACTACCCAAACTGGGTCCAAC<br>AAAAACCAGGTCAGGCACCCCGTGGTCTAATAGGTGGGACTAAGTTCCTCGCCCCCGGTACTCCT<br>GCCAGATTCTCAGGCTCCCTGCTTGGAGGCAAGGCTGCCCTCACCCTCTCAGGGGTACAGCCAGA<br>GGATGAGGCAGAATATTACTGTGTTCTATGGTACAGCAACCGCTGGGTGTTCGGTGGAGGAACCA<br>AACTGACTGTCCTA |
| 625. | ME05F6-H | murine | aa | EVQLLEQSGAEVVRPGTSVKMSCKAAGYTFTKYWIGWVKQRPGHGLEWIGDIHPGGGFANYNEKF<br>KGKATLTADTSSSTAYMQLSRLTSDDSAIYYCARSGYDYGSSYDHGMDYWGQGTTVTVSS |
| 626. | ME05F6-HCDR1 | murine | aa | KYWIG |
| 627. | ME05F6-HCDR2 | murine | aa | DIHPGGGFANYNEKFKG |
| 628. | ME05F6-HCDR3 | murine | aa | SGYDYGSSYDHGMDY |
| 629. | ME05F6-H | murine | nt | GAGGTGCAGCTGCTCGAGCAGTCTGGAGCTGAGGTGGTTAGGCCTGGGACTTCAGTGAAGATGTC<br>CTGCAAGGCTGCTGGATACACCTTCACTAAGTACTGGATAGGTTGGGTAAAGCAGAGGCCTGGAC<br>ATGGCCTTGAGTGGATTGGAGATATTCACCCTGGAGGTGGTTTTGCTAACTACAATGAGAAGTTC<br>AAGGGCAAGGCCACACTGACTGCAGACACATCCTCCAGCACAGCCTACATGCAGCTCAGCAGACT<br>GACATCTGATGACTCTGCCATCTATTACTGTGCAAGATCGGGTTATGACTACGGTAGTAGTTACG<br>ATTACCATGGTATGGACTACTGGGGCCAAGGGACCACGGTCACCGTCTCCTCA |
| 630. | ME05F6-L | murine | aa | ELVMTQSPSSLSASLGERVSLTCRASQEISGYLSWLQQKPDGTIKRLIYAASTLDSGVPKRFSGS<br>RSGSDYSLTISSLESEDFADYYCLQYASYPPTFGGGTKLEIK |
| 631. | ME05F6-LCDR1 | murine | aa | RASQEISGYLS |
| 632. | ME05F6-LCDR2 | murine | aa | AASTLDS |
| 633. | ME05F6-LCDR3 | murine | aa | LQYASYPPT |
| 634. | ME05F6-L | murine | nt | GAGCTCGTGATGACACAGTCTCCATCCTCCTTATCTGCCTCTCTGGGAGAAAGAGTCAGTCTCAC<br>TTGTCGGGCAAGTCAGGAAATTAGTGGTTACTTAAGCTGGCTTCAGCAGAAACCAGATGGAACTA<br>TTAAACGCCTGATCTACGCCGCATCCACTTTAGATTCTGGTGTCCCAAAAAGGTTCAGTGGCAGT<br>AGGTCTGGGTCAGATTATTCTCTCACCATCAGCAGCCTTGAGTCTGAAGATTTTGCAGACTATTA<br>CTGTCTACAATATGCTAGTTATCCTCCCACGTTCGGAGGGGGGACCAAGCTTGAGATCAAA |

| SEQ ID NO. | DESIGNATION | SOURCE | TYPE | SEQUENCE |
|---|---|---|---|---|
| 635. | ME05F6-HL | murine | aa | EVQLLEQSGAEVVRPGTSVKMSCKAAGYTFTKYWIGWVKQRPGHGLEWIGDIHPGGGFANYNEKF KGKATLTADTSSSTAYMQLSRLTSDDSAIYYCARSGYDYGSSYDYHGMDYWGQGTTVTVSSGGGG SGGGGSGGGGSELVMTQSPSSLSASLGERVSLTCRASQEISGYLSWLQQKPDGTIKRLIYAASTL DSGVPKRFSGSRSGSDYSLTISSLESEDFADYYCLQYASYPPTFGGGTKLEIK |
| 636. | ME05F6-HL | murine | nt | GAGGTGCAGCTGCTCGAGCAGTCTGGAGCTGAGGTGGTTAGGCCTGGGACTTCAGTGAAGATGTC CTGCAAGGCTGCTGGATACACCTTCACTAAGTACTGGATAGGTTGGGTAAAGCAGAGGCCTGGAC ATGGCCTTGAGTGGATTGGAGATATTCACCCTGGAGGTGGTTTTGCTAACTACAATGAGAAGTTC AAGGGCAAGGCCACACTGACTGCAGACACATCCTCCAGCACAGCCTACATGCAGCTCAGCAGACT GACATCTGATGACTCTGCCATCTATTACTGTGCAAGATCGGGTTATGACTACGGTAGTAGTTACG ATTACCATGGTATGGACTACTGGGGCCAAGGGACCACGGTCACCGTCTCCTCAGGTGGTGGTGGT TCTGGCGGCGGCGGCTCCGGTGGTGGTGGTTCTGAGCTCGTGATGACACAGTCTCCATCCTCCTT ATCTGCCTCTCTGGGAGAAAGAGTCAGTCTCACTTGTCGGGCAAGTCAGGAAATTAGTGGTTACT TAAGCTGGCTTCAGCAGAAACCAGATGGAACTATTAAACGCCTGATCTACGCCGCATCCACTTTA GATTCTGGTGTCCCAAAAAGGTTCAGTGGCAGTAGGTCTGGGTCAGATTATTCTCTCACCATCAG CAGCCTTGAGTCTGAAGATTTTGCAGACTATTACTGTCTACAATATGCTAGTTATCCTCCCACGT TCGGAGGGGGGACCAAGCTTGAGATCAAA |
| 637. | ME05F6 HL x I2C HL | murine | aa | EVQLLEQSGAEVVRPGTSVKMSCKAAGYTFTKYWIGWVKQRPGHGLEWIGDIHPGGGFANYNEKF KGKATLTADTSSSTAYMQLSRLTSDDSAIYYCARSGYDYGSSYDYHGMDYWGQGTTVTVSSGGGG SGGGGSGGGGSELVMTQSPSSLSASLGERVSLTCRASQEISGYLSWLQQKPDGTIKRLIYAASTL DSGVPKRFSGSRSGSDYSLTISSLESEDFADYYCLQYASYPPTFGGGTKLEIKSGGGGSEVQLVE SGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQAPRGLIGGTKFLAPGTP ARFSGSLLGGKAALTLSGVQPEDEAEYYCVLWYSNRWVFGGGTKLTVL |
| 638. | ME05F6 HL x I2C HL | murine | nt | GAGGTGCAGCTGCTCGAGCAGTCTGGAGCTGAGGTGGTTAGGCCTGGGACTTCAGTGAAGATGTC CTGCAAGGCTGCTGGATACACCTTCACTAAGTACTGGATAGGTTGGGTAAAGCAGAGGCCTGGAC ATGGCCTTGAGTGGATTGGAGATATTCACCCTGGAGGTGGTTTTGCTAACTACAATGAGAAGTTC AAGGGCAAGGCCACACTGACTGCAGACACATCCTCCAGCACAGCCTACATGCAGCTCAGCAGACT GACATCTGATGACTCTGCCATCTATTACTGTGCAAGATCGGGTTATGACTACGGTAGTAGTTACG ATTACCATGGTATGGACTACTGGGGCCAAGGGACCACGGTCACCGTCTCCTCAGGTGGTGGTGGT TCTGGCGGCGGCGGCTCCGGTGGTGGTGGTTCTGAGCTCGTGATGACACAGTCTCCATCCTCCTT ATCTGCCTCTCTGGGAGAAAGAGTCAGTCTCACTTGTCGGGCAAGTCAGGAAATTAGTGGTTACT TAAGCTGGCTTCAGCAGAAACCAGATGGAACTATTAAACGCCTGATCTACGCCGCATCCACTTTA GATTCTGGTGTCCCAAAAAGGTTCAGTGGCAGTAGGTCTGGGTCAGATTATTCTCTCACCATCAG CAGCCTTGAGTCTGAAGATTTTGCAGACTATTACTGTCTACAATATGCTAGTTATCCTCCCACGT TCGGAGGGGGGACCAAGCTTGAGATCAAATCCGGAGGTGGTGGATCCGAGGTGCAGCTGGTCGAG TCTGGAGGAGGATTGGTGCAGCCTGGAGGGTCATTGAAACTCTCATGTGCAGCCTCTGGATTCAC CTTCAATAAGTACGCCATGAACTGGGTCCGCCAGGCTCCAGGAAAGGGTTTGGAATGGGTTGCTC GCATAAGAAGTAAATATAATAATTATGCAACATATTATGCCGATTCAGTGAAAGACAGGTTCACC ATCTCCAGAGATGATTCAAAAAACACTGCCTATCTACAAATGAACAACTTGAAAACTGAGGACAC TGCCGTGTACTACTGTGTGAGACATGGGAACTTCGGTAATAGCTACATATCCTACTGGGCTTACT GGGGCCAAGGGACTCTGGTCACCGTCTCCTCAGGTGGTGGTGGTTCTGGCGGCGGCGGCTCCGGT GGTGGTTCTCAGACTGTTCTCAGGAACCTTCACTCACCGTATCCCTGGTGGACAGT CACACTCACTTGTGGCTCCTCGACTGGGGCTGTTACATCTGGCAACTACCCAAACTGGGTCCAAC AAAAACCAGGTCAGGCACCCCGTGGTCTAATAGGTGGGACTAAGTTCCTCGCCCCCGGTACTCCT GCCAGATTCTCAGGCTCCCTGCTTGGAGGCAAGGCTGCCCTCACCCTCTCAGGGGTACAGCCAGA GGATGAGGCAGAATATTACTGTGTTCTATGGTACAGCAACCGCTGGGTGTTCGGTGGAGGAACCA AACTGACTGTCCTA |
| 639. | ME06C6-H | murine | aa | EVQLLEQSGAELVRPGTSVKIPCKATGYTFSYYWIGWVKQRPGHGLEWIGDIYPGGGYSNYNEKF KGKATLTADTSSSTAYMQLSGLTSEDSAIYYCARSGYDYGSDYDHGLDYWGQGTTVTVSS |
| 640. | ME06C6-HCDR1 | murine | aa | YYWIG |
| 641. | ME06C6-HCDR2 | murine | aa | DIYPGGGYSNYNEKFKG |
| 642. | ME06C6-HCDR3 | murine | aa | SGYDYGSDYDHGLDY |
| 643. | ME06C6-H | murine | nt | GAGGTGCAGCTGCTCGAGCAGTCTGGAGCTGAACTGGTAAGGCCTGGGACTTCAGTGAAGATTCC CTGCAAGGCTACTGGATACACCTTCAGTTATTACTGGATAGGTTGGGTAAAGCAGAGGCCTGGAC ATGGCCTTGAGTGGATTGGAGATATTTACCCTGGAGGTGGTTATAGTAACTACAATGAGAAATTC AAGGGCAAAGGCCACACTGACTGCAGACACATCCTCCAGCACAGCCTACATGCAGCTCAGCGGCCT GACATCTGAGGACTCTGCCATCTATTACTGTGCAAGATCGGGATATGACTACGGTAGTGACTACG ATTACCATGGTCTGGACTACTGGGGCCAAGGGACCACGGTCACCGTCTCCTCA |
| 644. | ME06C6-L | murine | aa | ELVLTQSPASLAVSLGQRATISCRASESVEYYGTSLMQWYQQKPGQPPKLLIYAASNVESGVPAR FSGSGSGTDFSLNIHPVEEDDIAMYFCQQSRKVPYTFGGGTKLEIK |
| 645. | ME06C6-LCDR1 | murine | aa | RASESVEYYGTSLMQ |
| 646. | ME06C6-LCDR2 | murine | aa | AASNVES |

| SEQ ID NO. | DESIGNATION | SOURCE | TYPE | SEQUENCE |
|---|---|---|---|---|
| 647. | ME06C6-LCDR3 | murine | aa | QQSRKVPYT |
| 648. | ME06C6-L | murine | nt | GAGCTCGTGCTCACCCAGTCTCCAGCTTCTTTGGCTGTGTCTCTAGGGCAGAGAGCCACCATCTC CTGCAGAGCCAGTGAAAGTGTTGAATATTATGGCACAAGTTTAATGCAGTGGTACCAACAGAAAC CAGGACAGCCACCCAAACTCCTCATCTATGCTGCATCCAACGTAGAATCTGGGGTCCCTGCCAGG TTTAGTGGCAGTGGGTCTGGGACAGACTTCAGCCTCAACATCCATCCTGTGGAGGAGGATGATAT TGCAATGTATTTCTGTCAGCAAAGTAGGAAGGTTCCGTACACGTTCGGAGGGGGGACCAAGCTTG AGATCAAA |
| 649. | ME06C6-HL | murine | aa | EVQLLEQSGAELVRPGTSVKIPCKATGYTFSYYWIGWVKQRPGHGLEWIGDIYPGGGYSNYNEKF KGKATLTADTSSSTAYMQLSGLTSEDSAIYYCARSGYDYGSDYDYHGLDYWGQGTTVTVSSGGGG SGGGGSGGGGSELVLTQSPASLAVSLGQRATISCRASESVEYYGTSLMQWYQQKPGQPPKLLIYA ASNVESGVPARFSGSGSGTDFSLNIHPVEEDDIAMYFCQQSRKVPYTFGGGTKLEIK |
| 650. | ME06C6-HL | murine | nt | GAGGTGCAGCTGCTCGAGCAGTCTGGAGCTGAACTGGTAAGGCCTGGGACTTCAGTGAAGATTCC CTGCAAGGCTACTGGATACACCTTCAGTTATTACTGGATAGGTTGGGTAAAGCAGAGGCCTGGAC ATGGCCTTGAGTGGATTGGAGATATTTACCCTGGAGGTGGTTATAGTAACTACAATGAGAAATTC AAGGGAAAGGCCACACTGACTGCAGACACATCCTCCAGCACAGCCTACATGCAGCTCAGCGGCCT GACATCTGAGGACTCTGCCATCTATTACTGTGCAAGATCGGGATATGACTACGGTAGTGACTACG ATTACCATGGTCTGGACTACTGGGGCCAAGGGACCACGGTCACCGTCTCCTCAGGTGGTGGTGGT TCTGGCGGCGGCGGCTCCGGTGGTGGTGGTTCTGAGCTCGTGCTCACCCAGTCTCCAGCTTCTTT GGCTGTGTCTCTAGGGCAGAGAGCCACCATCTCCTGCAGAGCCAGTGAAAGTGTTGAATATTATG GCACAAGTTTAATGCAGTGGTACCAACAGAAACCAGGACAGCCACCCAAACTCCTCATCTATGCT GCATCCAACGTAGAATCTGGGGTCCCTGCCAGGTTTAGTGGCAGTGGGTCTGGGACAGACTTCAG CCTCAACATCCATCCTGTGGAGGAGGATGATATTGCAATGTATTTCTGTCAGCAAAGTAGGAAGG TTCCGTACACGTTCGGAGGGGGGACCAAGCTTGAGATCAAA |
| 651. | ME06C6 HL x I2C HL | murine | aa | EVQLLEQSGAELVRPGTSVKIPCKATGYTFSYYWIGWVKQRPGHGLEWIGDIYPGGGYSNYNEKF KGKATLTADTSSSTAYMQLSGLTSEDSAIYYCARSGYDYGSDYDYHGLDYWGQGTTVTVSSGGGG SGGGGSGGGGSELVLTQSPASLAVSLGQRATISCRASESVEYYGTSLMQWYQQKPGQPPKLLIYA ASNVESGVPARFSGSGSGTDFSLNIHPVEEDDIAMYFCQQSRKVPYTFGGGTKLEIKSGGGGSEV QLVESGGGLVQPGGSLKLSCAASGFTFNKYAMNWVRQAPGKGLEWVARIRSKYNNYATYYADSVK DRFTISRDDSKNTAYLQMNNLKTEDTAVYYCVRHGNFGNSYISYWAYWGQGTLVTVSSGGGGSGG GGSGGGGSQTVVTQEPSLTVSPGGTVTLTCGSSTGAVTSGNYPNWVQQKPGQAPRGLIGGTKFLA PGTPARFSGSLLGGKAALTLSGVQPEDEAEYYCVLWYSNRWVFGGGTKLTVL |
| 652. | ME06C6 HL x I2C HL | murine | nt | GAGGTGCAGCTGCTCGAGCAGTCTGGAGCTGAACTGGTAAGGCCTGGGACTTCAGTGAAGATTCC CTGCAAGGCTACTGGATACACCTTCAGTTATTACTGGATAGGTTGGGTAAAGCAGAGGCCTGGAC ATGGCCTTGAGTGGATTGGAGATATTTACCCTGGAGGTGGTTATAGTAACTACAATGAGAAATTC AAGGGAAAGGCCACACTGACTGCAGACACATCCTCCAGCACAGCCTACATGCAGCTCAGCGGCCT GACATCTGAGGACTCTGCCATCTATTACTGTGCAAGATCGGGATATGACTACGGTAGTGACTACG ATTACCATGGTCTGGACTACTGGGGCCAAGGGACCACGGTCACCGTCTCCTCAGGTGGTGGTGGT TCTGGCGGCGGCGGCTCCGGTGGTGGTGGTTCTGAGCTCGTGCTCACCCAGTCTCCAGCTTCTTT GGCTGTGTCTCTAGGGCAGAGAGCCACCATCTCCTGCAGAGCCAGTGAAAGTGTTGAATATTATG GCACAAGTTTAATGCAGTGGTACCAACAGAAACCAGGACAGCCACCCAAACTCCTCATCTATGCT GCATCCAACGTAGAATCTGGGGTCCCTGCCAGGTTTAGTGGCAGTGGGTCTGGGACAGACTTCAG CCTCAACATCCATCCTGTGGAGGAGGATGATATTGCAATGTATTTCTGTCAGCAAAGTAGGAAGG TTCCGTACACGTTCGGAGGGGGGACCAAGCTTGAGATCAAATCGGAGGTGGTGGATCCGAGGTG CAGCTGGTCGAGTCTGGAGGAGGATTGGTGCAGCCTGGAGGGTCATTGAAACTCTCATGTGCAGC CTCTGGATTCACCTTCAATAAGTACGCCATGAACTGGGTCCGCCAGGCTCCAGGAAAGGGTTTGG AATGGGTTGCTCGCATAAGAAGTAAATATAATAATTATGCAACATATTATGCCGATTCAGTGAAA GACAGGTTCACCATCTCCAGAGATGATTCAAAAAACACTGCCTATCTACAAATGAACAACTTGAA AACTGAGGACACTGCCGTGTACTACTGTGTGAGACATGGGAACTTCGGTAATAGCTACATATCCT ACTGGGCTTACTGGGGCCAAGGGACTCTGGTCACCGTCTCCTCAGGTGGTGGTGGTTCTGGCGGC GGCGGCTCCGGTGGTGGTGGTTCTCAGACTGTTGTGACTCAGGAACCTTCACTCACCGTATCACC TGGTGGAACAGTCACACTCACTTGTGGCTCCTCGACTGGGGCTGTTACATCGGCAACTACCCAA ACTGGGTCCAACAAAAACCAGGTCAGGCACCCCGTGGTCTAATAGGTGGGACTAAGTTCCTCGCC CCCGGTACTCCTGCCAGATTCTCAGGCTCCCTGCTTGGAGGCAAGGCTGCCCTCACCCTCTCAGG GGTACAGCCAGAGGATGAGGCAGAATATTACTGTGTTCTATGGTACAGCAACCGCTGGGTGTTCG GTGGAGGAACCAAACTGACTGTCCTA |
| 653. | ME06C7-H | murine | aa | EVQLLEQSGAEVVRPGTSVKMSCKAAGYTFTKYWIGWVKQRPGHGLEWIGDIHPGGGFANYNEKF KGKATLTADTSSSTAYMQLSRLTSDDSAIYYCARSGYDYGSSYDYHGMDYWGQGTTVTVSS |
| 654. | ME06C7-HCDR1 | murine | aa | KYWIG |
| 655. | ME06C7-HCDR2 | murine | aa | DIHPGGGFANYNEKFKG |
| 656. | ME06C7-HCDR3 | murine | aa | SGYDYGSSYDYHGMDY |
| 657. | ME06C7-H | murine | nt | GAGGTGCAGCTGCTCGAGCAGTCTGGAGCTGAGGTGGTAGGCCTGGGACTTCAGTGAAGATGTC CTGCAAGGCTGCTGGATACACCTTCACTAAGTACTGGATAGGTTGGGTAAAGCAGAGGCCTGGAC ATGGCCTTGAGTGGATTGGAGATATTCACCCTGGAGGTGGTTTTGCTAACTACAATGAGAAGTTC AAGGGCAAGGCCACACTGACTGCAGACACATCCTCCAGCACAGCCTACATGCAGCTCAGCAGACT |

| SEQ ID NO. | DESIGNATION | SOURCE | TYPE | SEQUENCE |
|---|---|---|---|---|
| | | | | GACATCTGATGACTCTGCCATCTATTACTGTGCAAGATCGGGTTATGACTACGGTAGTAGTTACG<br>ATTACCATGGTATGGACTACTGGGGCCAAGGGACCACGGTCACCGTCTCCTCA |
| 658. | ME06C7-L | murine | aa | ELQMTQSPTSLAVSLGQRATISCRASQTVYYDGNNYMNWYQHKPGQPPKLLIYATSNLESGIPAR<br>FSGSGSGTDFTLNIHPVEAEDAATYYCQQSYEDPYTFGGGTKLEIK |
| 659. | ME06C7-LCDR1 | murine | aa | RASQTVYYDGNNYMN |
| 660. | ME06C7-LCDR2 | murine | aa | ATSNLES |
| 661. | ME06C7-LCDR3 | murine | aa | QQSYEDPYT |
| 662. | ME06C7-L | murine | nt | GAGCTCCAGATGACCCAGTCTCCAACTTCTTTGGCTGTGTCTCTCGGGCAGAGGGCCACCATCTC<br>CTGCAGGGCCAGCCAAACTGTTTACTATGATGGTAATAATTATATGAACTGGTATCAACACAAAC<br>AGGACAGCCACCCAAACTCCTCATCTATGCTACATCCAATCTAGAATCTGGGATCCCAGCCAGG<br>TTTAGTGGCAGTGGGTCTGGGACAGACTTCACCCTCAACATCCATCCTGTGGAGGCGGAGGATGC<br>TGCAACCTATTACTGTCAGCAAAGTTATGAGGATCCGTACACGTTCGGAGGGGGGACCAAGCTTG<br>AGATCAAA |
| 663. | ME06C7-HL | murine | aa | EVQLLEQSGAEVVRPGTSVKMSCKAAGYTFTKYWIGWVKQRPGHGLEWIGDIHPGGGFANYNEKF<br>KGKATLTADTSSSTAYMQLSRLTSDDSAIYYCARSGYDYGSSYDYHGMDYWGQGTTVTVSSGGGG<br>SGGGGSGGGGSELQMTQSPTSLAVSLGQRATISCRASQTVYYDGNNYMNWYQHKPGQPPKLLIYA<br>TSNLESGIPARFSGSGSGTDFTLNIHPVEAEDAATYYCQQSYEDPYTFGGGTKLEIK |
| 664. | ME06C7-HL | murine | nt | GAGGTGCAGCTGCTCGAGCAGTCTGGAGCTGAGGTGGTTAGGCCTGGGACTTCAGTGAAGATGTC<br>CTGCAAGGCTGCTGGATACACCTTCACTAAGTACTGGATAGGTTGGGTAAAGCAGAGGCCTGGAC<br>ATGGCCTTGAGTGGATTGGAGATATTCACCCTGGAGGTGGTTTTGCTAACTACAATGAGAAGTTC<br>AAGGGCAAGGCCACACTGACTGCAGACACATCCTCCAGCACAGCCTACATGCAGCTCAGCAGACT<br>GACATCTGATGACTCTGCCATCTATTACTGTGCAAGATCGGGTTATGACTACGGTAGTAGTTACG<br>ATTACCATGGTATGGACTACTGGGGCCAAGGGACCACGGTCACCGTCTCCTCAGGTGGTGGTGGT<br>TCTGGCGGCGGCGGCTCCGGTGGTGGTGGTTCTGAGCTCCAGATGACCCAGTCTCCAACTTCTTT<br>GGCTGTGTCTCTCGGGCAGAGGGCCACCATCTCCTGCAGGGCCAGCCAAACTGTTTACTATGATG<br>GTAATAATTATATGAACTGGTATCAACACAAACAGGACAGCCACCCAAACTCCTCATCTATGCT<br>ACATCCAATCTAGAATCTGGGATCCCAGCCAGGTTTAGTGGCAGTGGGTCTGGGACAGACTTCAC<br>CCTCAACATCCATCCTGTGGAGGCGGAGGATGCTGCAACCTATTACTGTCAGCAAAGTTATGAGG<br>ATCCGTACACGTTCGGAGGGGGGACCAAGCTTGAGATCAAA |
| 665. | ME06C7 HL x I2C HL | murine | aa | EVQLLEQSGAEVVRPGTSVKMSCKAAGYTFTKYWIGWVKQRPGHGLEWIGDIHPGGGFANYNEKF<br>KGKATLTADTSSSTAYMQLSRLTSDDSAIYYCARSGYDYGSSYDYHGMDYWGQGTTVTVSSGGGG<br>SGGGGSGGGGSELQMTQSPTSLAVSLGQRATISCRASQTVYYDGNNYMNWYQHKPGQPPKLLIYA<br>TSNLESGIPARFSGSGSGTDFTLNIHPVEAEDAATYYCQQSYEDPYTFGGGTKLEIKSGGGGSEV<br>QLVESGGGLVQPGGSLKLSCAASGFTENKYAMNWVRQAPGKGLEWVARIRSKYNNYATYYADSVK<br>DRFTISRDDSKNTAYLQMNNLKTEDTAVYYCVRHGNFGNSYISYWAYWGQGTLVTVSSGGGGSGG<br>GGSGGGGSQTVVTQEPSLTVSPGGTVTLTCGSSTGAVTSGNYPNWVQQKPGQAPRGLIGGTKFLA<br>PGTPARFSGSLLGGKAALTLSGVQPEDEAEYYCVLWYSNRWVFGGGTKLTVL |
| 666. | ME06C7 HL x I2C HL | murine | nt | GAGGTGCAGCTGCTCGAGCAGTCTGGAGCTGAGGTGGTTAGGCCTGGGACTTCAGTGAAGATGTC<br>CTGCAAGGCTGCTGGATACACCTTCACTAAGTACTGGATAGGTTGGGTAAAGCAGAGGCCTGGAC<br>ATGGCCTTGAGTGGATTGGAGATATTCACCCTGGAGGTGGTTTTGCTAACTACAATGAGAAGTTC<br>AAGGGCAAGGCCACACTGACTGCAGACACATCCTCCAGCACAGCCTACATGCAGCTCAGCAGACT<br>GACATCTGATGACTCTGCCATCTATTACTGTGCAAGATCGGGTTATGACTACGGTAGTAGTTACG<br>ATTACCATGGTATGGACTACTGGGGCCAAGGGACCACGGTCACCGTCTCCTCAGGTGGTGGTGGT<br>TCTGGCGGCGGCGGCTCCGGTGGTGGTGGTTCTGAGCTCCAGATGACCCAGTCTCCAACTTCTTT<br>GGCTGTGTCTCTCGGGCAGAGGGCCACCATCTCCTGCAGGGCCAGCCAAACTGTTTACTATGATG<br>GTAATAATTATATGAACTGGTATCAACACAAACAGGACAGCCACCCAAACTCCTCATCTATGCT<br>ACATCCAATCTAGAATCTGGGATCCCAGCCAGGTTTAGTGGCAGTGGGTCTGGGACAGACTTCAC<br>CCTCAACATCCATCCTGTGGAGGCGGAGGATGCTGCAACCTATTACTGTCAGCAAAGTTATGAGG<br>ATCCGTACACGTTCGGAGGGGGGACCAAGCTTGAGATCAAATCGGAGGTGGTGGATCCGAGGTG<br>CAGCTGGTCGAGTCTGGAGGAGGATTGGTGCAGCCTGGAGGGTCATTGAAACTCTCATGTGCAGC<br>CTCTGGATTCACCTTCAATAAGTACGCCATGAACTGGGTCCGCCAGGCTCCAGGAAAGGGTTTGG<br>AATGGGTTGCTCGCATAAGAAGTAAATATAATAATTATGCAACATATTATGCCGATTCAGTGAAA<br>GACAGGTTCACCATCTCCAGAGATGATTCAAAAACACTGCCTATCTACAAATGAACAACTTGAA<br>AACTGAGGACACTGCCGTGTACTACTGTGTGAGACATGGGAACTTCGGTAATAGCTACATATCCT<br>ACTGGGCTTACTGGGGCCAAGGGACTCTGGTCACCGTCTCCTCAGGTGGTGGTGGTTCTGGCGGC<br>GGCGGCTCCGGTGGTGGTGGTTCTGAGCTCCAGACTGTTGTGACTCAGGAACCTTCACTCACCGT<br>GTCGCCTGGCGGCACAGTCACACTCACTTGTGGCTCCTCGACTGGGGCTGTTACATCTGGCAACTACCCAA<br>ACTGGGTCCAACAAAAACCAGGTCAGGCACCCCGTGGTCTAATAGGTGGGACTAAGTTCCTCGCC<br>CCCGGTACTCCTGCCAGATTCTCAGGCTCCCTGCTTGGAGGCAAGGCTGCCCTCACCCTCTCAGG<br>GGTACAGCCAGAGGATGAGGCAGAATATTACTGTGTTCTATGGTACAGCAACCGCTGGGTGTTCG<br>GTGGAGGAACCAAACTGACTGTCCTA |
| 667. | ME06B7-H | murine | aa | EVQLLEQSGAELVRPGTSVKISCKATGYTFTTYWLGWVKQRPGHGLEWIGEIHPGGGYTNYNEKF<br>KGKATLTADTSSSTAYMQLSRLTSDDSAIYYCARSGYDYGSSYDYYGMDYWGQGTTVTVSS |
| 668. | ME06B7-HCDR1 | murine | aa | TYWLG |

-continued

| SEQ ID NO. | DESIGNATION | SOURCE | TYPE | SEQUENCE |
|---|---|---|---|---|
| 669. | ME06B7-HCDR2 | murine | aa | EIHPGGGYTNYNEKFKG |
| 670. | ME06B7-HCDR3 | murine | aa | SGYDYGSSYDYYGMDY |
| 671. | ME06B7-H | murine | nt | GAGGTGCAGCTGCTCGAGCAGTCTGGAGCTGAACTGGTAAGGCCTGGGACCTCAGTGAAGATTTC<br>CTGCAAGGCTACTGGATACACCTTCACTACTTACTGGCTAGGTTGGGTAAAGCAGAGGCCTGGAC<br>ATGGCCTTGAGTGGATTGGAGAGATTCACCCTGGAGGTGGTTATACTAACTACAATGAGAAGTTC<br>AAGGGCAAGGCCACACTGACTGCAGACACATCCTCCAGCACAGCCTACATGCAGCTCAGCAGACT<br>GACATCTGATGACTCCGCCATCTATTACTGTGCAAGATCGGGGTATGACTACGGTAGTAGTTACG<br>ATTACTATGGTATGGACTACTGGGGCCAAGGGACCACGGTCACCGTCTCCTCA |
| 672. | ME06B7-L | murine | aa | ELVMTQSPSSLSASLGERVSLTCRASQDIGSSLNWLQQEPDGTIKRLIYATSSLDSGVPKRFSGS<br>RSGSDYSLTISSLESEDFVDYYCLQYASSPYTFGGGTKLEIK |
| 673. | ME06B7-LCDR1 | murine | aa | RASQDIGSSLN |
| 674. | ME06B7-LCDR2 | murine | aa | ATSSLDS |
| 675. | ME06B7-LCDR3 | murine | aa | LQYASSPYT |
| 676. | ME06B7-L | murine | nt | GAGCTCGTCATGACCCAGTCTCCATCCTCCTTATCTGCCTCTCTGGGAGAAAGAGTCAGTCTCAC<br>TTGTCGGGCAAGTCAGGACATTGGTAGTAGCTTAAACTGGCTTCAGCAGGAACCAGATGGAACTA<br>TTAAACGCCTGATCTACGCCACATCCAGTTTAGATTCTGGTGTCCCCAAAAGGTTCAGTGGCAGT<br>AGGTCTGGGTCAGATTATTCTCTCACCATCAGCAGCCTTGAGTCTGAAGATTTTGTAGACTATTA<br>CTGTCTACAATATGCTAGTTCTCCGTACACGTTCGGAGGGGGGACCAAGCTTGAGATCAAA |
| 677. | ME06B7-HL | murine | aa | EVQLLEQSGAELVRPGTSVKISCKATGYTFTTYWLGWVKQRPGHGLEWIGEIHPGGGYTNYNEKF<br>KGKATLTADTSSSTAYMQLSRLTSDDSAIYYCARSGYDYGSSYDYYGMDYWGQGTTVTVSSGGGG<br>SGGGGSGGGGSELVMTQSPSSLSASLGERVSLTCRASQDIGSSLNWLQQEPDGTIKRLIYATSSL<br>DSGVPKRFSGSRSGSDYSLTISSLESEDFVDYYCLQYASSPYTFGGGTKLEIK |
| 678. | ME06B7-HL | murine | nt | GAGGTGCAGCTGCTCGAGCAGTCTGGAGCTGAACTGGTAAGGCCTGGGACCTCAGTGAAGATTTC<br>CTGCAAGGCTACTGGATACACCTTCACTACTTACTGGCTAGGTTGGGTAAAGCAGAGGCCTGGAC<br>ATGGCCTTGAGTGGATTGGAGAGATTCACCCTGGAGGTGGTTATACTAACTACAATGAGAAGTTC<br>AAGGGCAAGGCCACACTGACTGCAGACACATCCTCCAGCACAGCCTACATGCAGCTCAGCAGACT<br>GACATCTGATGACTCCGCCATCTATTACTGTGCAAGATCGGGGTATGACTACGGTAGTAGTTACG<br>ATTACTATGGTATGGACTACTGGGGCCAAGGGACCACGGTCACCGTCTCCTCAGGTGGTGGTGGT<br>TCTGGCGGCGGCGGCTCCGGTGGTGGTTCTGAGCTCGTCATGACCCAGTCTCCATCCTCCTT<br>ATCTGCCTCTCTGGGAGAAAGAGTCAGTCTCACTTGTCGGGCAAGTCAGGACATTGGTAGTAGCT<br>TAAACTGGCTTCAGCAGGAACCAGATGGAACTATTAAACGCCTGATCTACGCCACATCCAGTTTA<br>GATTCTGGTGTCCCCAAAAGGTTCAGTGGCAGTAGGTCTGGGTCAGATTATTCTCTCACCATCAG<br>CAGCCTTGAGTCTGAAGATTTTGTAGACTATTACTGTCTACAATATGCTAGTTCTCCGTACACGT<br>TCGGAGGGGGGACCAAGCTTGAGATCAAA |
| 679. | ME06B7 HL x I2C HL | murine | aa | EVQLLEQSGAELVRPGTSVKISCKATGYTFTTYWLGWVKQRPGHGLEWIGEIHPGGGYTNYNEKF<br>KGKATLTADTSSSTAYMQLSRLTSDDSAIYYCARSGYDYGSSYDYYGMDYWGQGTTVTVSSGGGG<br>SGGGGSGGGGSELVMTQSPSSLSASLGERVSLTCRASQDIGSSLNWLQQEPDGTIKRLIYATSSL<br>DSGVPKRFSGSRSGSDYSLTISSLESEDFVDYYCLQYASSPYTFGGGTKLEIKSGGGGSEVQLVE<br>SGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSG<br>GGGSQTVVTQEPSLTVSPGGTVTLTCGSSTGAVTSGNYPNWVQQKPGQAPRGLIGGTKFLAPGTP<br>ARFSGSLLGGKAALTLSGVQPEDEAEYYCVLWYSNRWVFGGGTKLTVL |
| 680. | ME06B7 HL x I2C HL | murine | nt | GAGGTGCAGCTGCTCGAGCAGTCTGGAGCTGAACTGGTAAGGCCTGGGACCTCAGTGAAGATTTC<br>CTGCAAGGCTACTGGATACACCTTCACTACTTACTGGCTAGGTTGGGTAAAGCAGAGGCCTGGAC<br>ATGGCCTTGAGTGGATTGGAGAGATTCACCCTGGAGGTGGTTATACTAACTACAATGAGAAGTTC<br>AAGGGCAAGGCCACACTGACTGCAGACACATCCTCCAGCACAGCCTACATGCAGCTCAGCAGACT<br>GACATCTGATGACTCCGCCATCTATTACTGTGCAAGATCGGGGTATGACTACGGTAGTAGTTACG<br>ATTACTATGGTATGGACTACTGGGGCCAAGGGACCACGGTCACCGTCTCCTCAGGTGGTGGTGGT<br>TCTGGCGGCGGCGGCTCCGGTGGTGGTTCTGAGCTCGTCATGACCCAGTCTCCATCCTCCTT<br>ATCTGCCTCTCTGGGAGAAAGAGTCAGTCTCACTTGTCGGGCAAGTCAGGACATTGGTAGTAGCT<br>TAAACTGGCTTCAGCAGGAACCAGATGGAACTATTAAACGCCTGATCTACGCCACATCCAGTTTA<br>GATTCTGGTGTCCCCAAAAGGTTCAGTGGCAGTAGGTCTGGGTCAGATTATTCTCTCACCATCAG<br>CAGCCTTGAGTCTGAAGATTTTGTAGACTATTACTGTCTACAATATGCTAGTTCTCCGTACACGT<br>TCGGAGGGGGGACCAAGCTTGAGATCAAATCCGGAGGTGTGGATCCGAGGTGCAGCTGGTCGAG<br>TCTGGAGGAGGATTGGTGCAGCCTGGAGGGTCATTGAAACTCTCATGTGCAGCCTCTGGATTCAC<br>CTTCAATAAGTACGCCATGAACTGGGTCCGCCAGGCTCCAGGAAAGGGTTTGGAATGGGTTGCTC<br>GCATAAGAAGTAAATATAATAATTATGCAACATATTATGCCGATTCAGTGAAGACAGGTTCACC<br>ATCTCCAGAGATGATTCAAAAAACACTGCCTATCTACAAATGAACAACTTGAAAACTGAGGACAC<br>TGCCGTGTACTACTGTGTGAGACATGGGAACTTCGGTAATAGCTACATATCCTACTGGGCTTACT<br>GGGGCCAAGGGACTCTGGTCACCGTCTCCTCAGGTGGTGGTGGTTCTGGCGGCGGCGGCTCCGGT<br>GGTGGTGGTTCTCAGACTGTTGTGACTCAGGAACCTTCACTCACCGTATCACCTGGTGAACAGT<br>CACACTCACTTGTGGCTCCTCGACTGGGGCTGTTACATCTGGCAACTACCCAAACTGGGTCCAAC<br>AAAAACCAGGTCAGGCACCCCGTGGTCTAATAGGTGGGACTAAGTTCCTCGCCCCCGGTACTCCT<br>GCCAGATTCTCAGGCTCCCTGCTTGGAGGCAAGGCTGCCCTCACCCTCTCAGGGGTACAGCAGA |

| SEQ ID NO. | DESIGNATION | SOURCE | TYPE | SEQUENCE |
|---|---|---|---|---|
| | | | | GGATGAGGCAGAATATTACTGTGTTCTATGGTACAGCAACCGCTGGGTGTTCGGTGGAGGAACCA AACTGACTGTCCTA |
| 681. | ME06D1-H | murine | aa | EVQLLEQSGAEVVRPGTSVKMSCKAAGYTFTKYWIGWVKQRPGHGLEWIGDIHPGGGFANYNEKF KGKATLTADTSSSTAYMQLSRLTSDDSAIYYCARSGYDYGSSYDYHGMDYWGQGTTVTVSS |
| 682. | ME06D1-HCDR1 | murine | aa | KYWIG |
| 683. | ME06D1-HCDR2 | murine | aa | DIHPGGGFANYNEKFKG |
| 684. | ME06D1-HCDR3 | murine | aa | SGYDYGSSYDYHGMDY |
| 685. | ME06D1-H | murine | nt | GAGGTGCAGCTGCTCGAGCAGTCTGGAGCTGAGGTGGTTAGGCCTGGGACTTCAGTGAAGATGTC CTGCAAGGCTGCTGGATACACCTTCACTAAGTACTGGATAGGTTGGGTAAAGCAGAGGCCTGGAC ATGGCCTTGAGTGGATTGGAGATATTCACCCTGGAGGTGGTTTTGCTAACTACAATGAGAAGTTC AAGGGCAAGGCCACACTGACTGCAGACACATCCTCCAGCACAGCCTACATGCAGCTCAGCAGACT GACATCTGATGACTCTGCCATCTATTACTGTGCAAGATCGGGTTATGACTACGGTAGTAGTTACG ATTACCATGGTATGGACTACTGGGGCCAAGGGACCACGGTCACCGTCTCCTCA |
| 686. | ME06D1-L | murine | aa | ELVMTQSPSSLTVTAGEKVTMSCKSSQSLLNSGNQKNYLAWYQQKPGQPPKLLIYGASTRESGVP DRFTGSGSGTDFTLTISSVQAEDLADYFCQQHYSTPYTFGGGTKLEIK |
| 687. | ME06D1-LCDR1 | murine | aa | KSSQSLLNSGNQKNYLA |
| 688. | ME06D1-LCDR2 | murine | aa | GASTRES |
| 689. | ME06D1-LCDR3 | murine | aa | QQHYSTPYT |
| 690. | ME06D1-L | murine | nt | GAGCTCGTGATGACACAGTCTCCATCCTCCCTGACTGTGACAGCAGGAGAGAAGGTCACTATGAG CTGCAAGTCCAGTCAGAGTCTGTTAAACAGTGGAAATCAAAAGAACTACTTGGCCTGGTACCAGC AGAAACCAGGGCAGCCTCCTAAACTGTTGATCTACGGGGCATCCACTAGGGAATCTGGAGTCCCT GATCGCTTCACAGGCAGTGGATCTGGGACAGATTTCACTCTTACCATCAGCAGTGTGCAGGCTGA AGACCTGGCAGATTACTTCTGTCAGCAACATTATAGCACTCCGTACACGTTCGGAGGGGGGACCA AGCTTGAGATCAAA |
| 691. | ME06D1-HL | murine | aa | EVQLLEQSGAEVVRPGTSVKMSCKAAGYTFTKYWIGWVKQRPGHGLEWIGDIHPGGGFANYNEKF KGKATLTADTSSSTAYMQLSRLTSDDSAIYYCARSGYDYGSSYDYHGMDYWGQGTTVTVSSGGGG SGGGGSGGGGSELVMTQSPSSLTVTAGEKVTMSCKSSQSLLNSGNQKNYLAWYQQKPGQPPKLLI YGASTRESGVPDRFTGSGSGTDFTLTISSVQAEDLADYFCQQHYSTPYTFGGGTKLEIK |
| 692. | ME06D1-HL | murine | nt | GAGGTGCAGCTGCTCGAGCAGTCTGGAGCTGAGGTGGTTAGGCCTGGGACTTCAGTGAAGATGTC CTGCAAGGCTGCTGGATACACCTTCACTAAGTACTGGATAGGTTGGGTAAAGCAGAGGCCTGGAC ATGGCCTTGAGTGGATTGGAGATATTCACCCTGGAGGTGGTTTTGCTAACTACAATGAGAAGTTC AAGGGCAAGGCCACACTGACTGCAGACACATCCTCCAGCACAGCCTACATGCAGCTCAGCAGACT GACATCTGATGACTCTGCCATCTATTACTGTGCAAGATCGGGTTATGACTACGGTAGTAGTTACG ATTACCATGGTATGGACTACTGGGGCCAAGGGACCACGGTCACCGTCTCCTCAGGTGGTGGTGGT TCTGGCGGCGGCGGCTCCGGTGGTGGTTCTGAGCTCGTGATGACACAGTCTCCATCCTCCCT GACTGTGACAGCAGGAGAGAAGGTCACTATGAGCTGCAAGTCCAGTCAGAGTCTGTTAAACAGTG GAAATCAAAAGAACTACTTGGCCTGGTACCAGCAGAAACCAGGGCAGCCTCCTAAACTGTTGATC TACGGGGCATCCACTAGGGAATCTGGAGTCCCTGATCGCTTCACAGGCAGTGGATCTGGGACAGA TTTCACTCTTACCATCAGCAGTGTGCAGGCTGAAGACCTGGCAGATTACTTCTGTCAGCAACATT ATAGCACTCCGTACACGTTCGGAGGGGGGACCAAGCTTGAGATCAAA |
| 693. | ME06D1 HL x I2C HL | murine | aa | EVQLLEQSGAEVVRPGTSVKMSCKAAGYTFTKYWIGWVKQRPGHGLEWIGDIHPGGGFANYNEKF KGKATLTADTSSSTAYMQLSRLTSDDSAIYYCARSGYDYGSSYDYHGMDYWGQGTTVTVSSGGGG SGGGGSGGGGSELVMTQSPSSLTVTAGEKVTMSCKSSQSLLNSGNQKNYLAWYQQKPGQPPKLLI YGASTRESGVPDRFTGSGSGTDFTLTISSVQAEDLADYFCQQHYSTPYTFGGGTKLEIKSGGGGS EVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGS GGGGSGGGGSQTVVTQEPSLTVSPGGTVTLTCGSSTGAVTSGNYPNWVQQKPGQAPRGLIGGTKF LAPGTPARFSGSLLGGKAALTLSGVQPEDEAEYYCVLWYSNRWVFGGGTKLTVL |
| 694. | ME06D1 HL x I2C HL | murine | nt | GAGGTGCAGCTGCTCGAGCAGTCTGGAGCTGAGGTGGTTAGGCCTGGGACTTCAGTGAAGATGTC CTGCAAGGCTGCTGGATACACCTTCACTAAGTACTGGATAGGTTGGGTAAAGCAGAGGCCTGGAC ATGGCCTTGAGTGGATTGGAGATATTCACCCTGGAGGTGGTTTTGCTAACTACAATGAGAAGTTC AAGGGCAAGGCCACACTGACTGCAGACACATCCTCCAGCACAGCCTACATGCAGCTCAGCAGACT GACATCTGATGACTCTGCCATCTATTACTGTGCAAGATCGGGTTATGACTACGGTAGTAGTTACG ATTACCATGGTATGGACTACTGGGGCCAAGGGACCACGGTCACCGTCTCCTCAGGTGGTGGTGGT TCTGGCGGCGGCGGCTCCGGTGGTGGTTCTGAGCTCGTGATGACACAGTCTCCATCCTCCCT GACTGTGACAGCAGGAGAGAAGGTCACTATGAGCTGCAAGTCCAGTCAGAGTCTGTTAAACAGTG GAAATCAAAAGAACTACTTGGCCTGGTACCAGCAGAAACCAGGGCAGCCTCCTAAACTGTTGATC TACGGGGCATCCACTAGGGAATCTGGAGTCCCTGATCGCTTCACAGGCAGTGGATCTGGGACAGA TTTCACTCTTACCATCAGCAGTGTGCAGGCTGAAGACCTGGCAGATTACTTCTGTCAGCAACATT ATAGCACTCCGTACACGTTCGGAGGGGGGACCAAGCTTGAGATCAAATCCGGAGGTGGTGGATCC GAGGTGCAGCTGGTCGAGTCTGGAGGAGGATTGGTGCAGCCTGGAGGGTCATTGAAACTCTCATG |

| SEQ ID NO. | DESIGNATION | SOURCE | TYPE | SEQUENCE |
|---|---|---|---|---|
| | | | | TGCAGCCTCTGGATTCACCTTCAATAAGTACGCCATGAACTGGGTCCGCCAGGCTCCAGGAAGG<br>GTTTGGAATGGGTTGCTCGCATAAGAAGTAAATATAATAATTATGCAACATATTATGCCGATTCA<br>GTGAAAGACAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACA<br>TATCCTACTGGGCTTACTGGGGCCAAGGGACTCTGGTCACCGTCTCCTCAGGTGGTGGTGGTTCT<br>GGCGGCGGCGGCTCCGGTGGTGGTGGTTCTCAGACTGTTGTGACTCAGGAACCTTCACTCACCGT<br>ATCACCTGGTGGAACAGTCACACTCACTTGTGGCTCCTCGACTGGGGCTGTTACATCTGGCAACT<br>ACCCAAACTGGGTCCAACAAAAACCAGGTCAGGCACCCCGTGGTCTAATAGGTGGGACTAAGTTC<br>CTCGCCCCCGGTACTCCTGCCAGATTCTCAGGCTCCCTGCTTGGAGGCAAGGCTGCCCTCACCCT<br>CTCAGGGGTACAGCCAGAGGATGAGGCAGAATATTACTGTGTTCTATGGTACAGCAACCGCTGGG<br>TGTTCGGTGGAGGAACCAAACTGACTGTCCTA |
| 695. | ME06D2-H | murine | aa | EVQLLEQSGADLVRPGTSVKLSCKAAGYTFSRYWISWIRQRPGHGLEWIGEIYPGGGYGNYNENF<br>KDKVTLTADTSSSTAYMQLSSLTSEDSAIYYCARSGYDYGSKYDYYGLDYWGQGTTVTVSS |
| 696. | ME06D2-HCDR1 | murine | aa | RYWIS |
| 697. | ME06D2-HCDR2 | murine | aa | EIYPGGGYGNYNENFKD |
| 698. | ME06D2-HCDR3 | murine | aa | SGYDYGSKYDYYGLDY |
| 699. | ME06D2-H | murine | nt | GAGGTGCAGCTGCTCGAGCAGTCTGGAGCTGACCTGGTAAGGCCTGGGACTTCAGTGAAGCTGTC<br>CTGCAAGGCTGCTGGATACACCTTCAGTAGGTATTGGATAAGTTGGATAAGGCAGAGGCCTGGAC<br>ATGGCCTTGAGTGGATTGGAGAAATTTACCCTGGAGGTGGTTATGGTAACTACAATGAGAATTTC<br>AAGGACAAGGTCACACTGACTGCAGACACATCCTCCAGCACAGCCTATATGCAGCTCAGCAGCCT<br>GACATCTGAGGACTCTGCCATCTATTATTGTGCAAGATCGGGGTATGACTACGGCAGTAAGTACG<br>ATTATTATGGTTTGGACTACTGGGGCCAAGGGACCACGGTCACCGTCTCCTCA |
| 700. | ME06D2-L | murine | aa | ELVMTQSPSSMYASLGERVTITCKASQDINSYLSWFQQKPGKSPKTLIYRANRLVDGVPSRFSGS<br>GSGQDYSLTISSLEYEDMGIYYCLQYDAFPPTFGAGTKLEIK |
| 701. | ME06D2-LCDR1 | murine | aa | KASQDINSYLS |
| 702. | ME06D2-LCDR2 | murine | aa | RANRLVD |
| 703. | ME06D2-LCDR3 | murine | aa | LQYDAFPPT |
| 704. | ME06D2-L | murine | nt | GAGCTCGTGATGACACAGTCTCCATCTTCCATGTATGCATCTCTAGGAGAGAGAGTCACTATCAC<br>TTGCAAGGCGAGTCAGGACATTAATAGCTATTTAAGCTGGTTCCAGCAGAAACCAGGGAAATCTC<br>CTAAGACCCTGATCTATCGTGCAAACAGATTGGTAGATGGGGTCCCATCAAGGTTCAGTGGCAGT<br>GGATCTGGGCAAGATTATTCTCTCACCATCAGCAGCCTGGAGTATGAAGATATGGGAATTTATTA<br>TTGTCTACAGTATGATGCGTTTCCTCCCACGTTCGGTGCTGGGACCAAGCTTGAGATCAAA |
| 705. | ME06D2-HL | murine | aa | EVQLLEQSGADLVRPGTSVKLSCKAAGYTFSRYWISWIRQRPGHGLEWIGEIYPGGGYGNYNENF<br>KDKVTLTADTSSSTAYMQLSSLTSEDSAIYYCARSGYDYGSKYDYYGLDYWGQGTTVTVSSGGGG<br>SGGGGSGGGGSELVMTQSPSSMYASLGERVTITCKASQDINSYLSWFQQKPGKSPKTLIYRANRL<br>VDGVPSRFSGSGSGQDYSLTISSLEYEDMGIYYCLQYDAFPPTFGAGTKLEIK |
| 706. | ME06D2-HL | murine | nt | GAGGTGCAGCTGCTCGAGCAGTCTGGAGCTGACCTGGTAAGGCCTGGGACTTCAGTGAAGCTGTC<br>CTGCAAGGCTGCTGGATACACCTTCAGTAGGTATTGGATAAGTTGGATAAGGCAGAGGCCTGGAC<br>ATGGCCTTGAGTGGATTGGAGAAATTTACCCTGGAGGTGGTTATGGTAACTACAATGAGAATTTC<br>AAGGACAAGGTCACACTGACTGCAGACACATCCTCCAGCACAGCCTATATGCAGCTCAGCAGCCT<br>GACATCTGAGGACTCTGCCATCTATTATTGTGCAAGATCGGGGTATGACTACGGCAGTAAGTACG<br>ATTATTATGGTTTGGACTACTGGGGCCAAGGGACCACGGTCACCGTCTCCTCAGGTGGTGGTGGT<br>TCTGGCGGCGGCGGCTCCGGTGGTGGTGGTTCTGAGCTCGTGATGACACAGTCTCCATCTTCCAT<br>GTATGCATCTCTAGGAGAGAGAGTCACTATCACTTGCAAGGCGAGTCAGGACATTAATAGCTATT<br>TAAGCTGGTTCCAGCAGAAACCAGGGAAATCTCCTAAGACCCTGATCTATCGTGCAAACAGATTG<br>GTAGATGGGGTCCCATCAAGGTTCAGTGGCAGTGGATCTGGGCAAGATTATTCTCTCACCATCAG<br>CAGCCTGGAGTATGAAGATATGGGAATTTATTATTGTCTACAGTATGATGCGTTTCCTCCCACGT<br>TCGGTGCTGGGACCAAGCTTGAGATCAAA |
| 707. | ME06D2 HL x I2C HL | murine | aa | EVQLLEQSGADLVRPGTSVKLSCKAAGYTFSRYWISWIRQRPGHGLEWIGEIYPGGGYGNYNENF<br>KDKVTLTADTSSSTAYMQLSSLTSEDSAIYYCARSGYDYGSKYDYYGLDYWGQGTTVTVSSGGGG<br>SGGGGSGGGGSELVMTQSPSSMYASLGERVTITCKASQDINSYLSWFQQKPGKSPKTLIYRANRL<br>VDGVPSRFSGSGSGQDYSLTISSLEYEDMGIYYCLQYDAFPPTFGAGTKLEIKSGGGGSEVQLVE<br>SGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSG<br>GGGSQTVVTQEPSLTVSPGGTVTLTCGSSTGAVTSGNYPNWVQQKPGQAPRGLIGGTKFLAPGTP<br>ARFSGSLLGGKAALTLSGVQPEDEAEYYCVLWYSNRWVFGGGTKLTVL |
| 708. | ME06D2 HL x I2C HL | murine | nt | GAGGTGCAGCTGCTCGAGCAGTCTGGAGCTGACCTGGTAAGGCCTGGGACTTCAGTGAAGCTGTC<br>CTGCAAGGCTGCTGGATACACCTTCAGTAGGTATTGGATAAGTTGGATAAGGCAGAGGCCTGGAC<br>ATGGCCTTGAGTGGATTGGAGAAATTTACCCTGGAGGTGGTTATGGTAACTACAATGAGAATTTC<br>AAGGACAAGGTCACACTGACTGCAGACACATCCTCCAGCACAGCCTATATGCAGCTCAGCAGCCT<br>GACATCTGAGGACTCTGCCATCTATTATTGTGCAAGATCGGGGTATGACTACGGCAGTAAGTACG |

| SEQ ID NO. | DESIGNATION | SOURCE | TYPE | SEQUENCE |
|---|---|---|---|---|
| | | | | ATTATTATGGTTTGGACTACTGGGGCCAAGGGACCACGGTCACCGTCTCCTCAGGTGGTGGTGGT TCTGGCGGCGGCGGCTCCGGTGGTGGTGGTTCTGAGCTCGTGATGACACAGTCTCCATCTTCCAT GTATGCATCTCTAGGAGAGAGAGTCACTATCACTTGCAAGGCGAGTCAGGACATTAATAGCTATT TAAGCTGGTTCCAGCAGAAACCAGGGAAATCTCCTAAGACCCTGATCTATCGTGCAAACAGATTG GTAGATGGGGTCCCATCAAGGTTCAGTGGCAGTGGATCTGGGCAAGATTATTCTCTCACCATCAG CAGCCTGGAGTATGAAGATATGGGAATTTATTATTGTCTACAGTATGATGCGTTTCCTCCCACGT TCGGTGCTGGGACCAAGCTTGAGATCAAATCCGGAGGTGGTGGATCCGAGGTGCAGCTGGTCGAG TCTGGAGGAGGATTGGTGCAGCCTGGAGGGTCATTGAAACTCTCATGTGCAGCCTCTGGATTCAC CTTCAATAAGTACGCCATGAACTGGGTCCGCCAGGCTCCAGGAAAGGGTTTGGAATGGGTTGCTC GCATAAGAAGTAAATATAATAATTATGCAACATATTATGCCGATTCAGTGAAAGACAGGTTCACC ATCTCCAGAGATGATTCAAAAAACACTGCCTATCTACAAATGAACAACTTGAAAACTGAGGACAC TGCCGTGTACTACTGTGTGAGACATGGGAACTTCGGTAATAGCTACATATCCTACTGGGCTTACT GGGGCCAAGGGACTCTGGTCACCGTCTCCTCAGGTGGTGGTGGTTCTGGCGGCGGCGGCTCCGGT GGTGGTGGTTCTCAGACTGTTGTGACTCAGGAACCTTCACTCACCGTATCACCTGGTGAACAGT CACACTCACTTGTGGCTCCTGACTGGGGCTGTTACATCTGGCAACTACCCAAACTGGGTCCAAC AAAAACCAGGTCAGGCACCCCGTGGTCTAATAGGTGGGACTAAGTTCCTCGCCCCCGGTACTCCT GCCAGATTCTCAGGCTCCCTGCTTGGAGGCAAGGCTGCCCTCACCCTCTCAGGGGTACAGCCAGA GGATGAGGCAGAATATTACTGTGTTCTATGGTACAGCAACCGCTGGGTGTTCGGTGGAGGAACCA AACTGACTGTCCTA |
| 709. | ME06E10-H | murine | aa | EVQLLEQSGADLVRPGTSVKLSCKAAGYTFSRYWISWIRQRPGHGLEWIGEIYPGGGYGNYNENF KDKVTLTADTSSSTAYMQLSSLTSEDSAIYYCARSGYDYGSKYDYYGLDYWGQGTTVTVSS |
| 710. | ME06E10-HCDR1 | murine | aa | RYWIS |
| 711. | ME06E10-HCDR2 | murine | aa | EIYPGGGYGNYNENFKD |
| 712. | ME06E10-HCDR3 | murine | aa | SGYDYGSKYDYYGLDY |
| 713. | ME06E10-H | murine | nt | GAGGTGCAGCTGCTCGAGCAGTCTGGAGCTGACCTGGTAAGGCCTGGGACTTCAGTGAAGCTGTC CTGCAAGGCTGCTGGATACACCTTCAGTAGGTATTGGATAAGTTGGATAAGGCAGAGGCCTGGAC ATGGGCTTGAGTGGATTGGAGAAATTTACCCTGGAGGTGGTTATGGTAACTACAATGAGAATTTC AAGGACAAGGTCACACTGACTGCAGACACATCCTCCAGCACAGCCTATATGCAGCTCAGCAGCCT GACATCTGAGGACTCTGCCATCTATTATTGTGCAAGATCGGGGTATGACTACGGCAGTAAGTACG ATTATTATGGTTTGGACTACTGGGGCCAAGGGACCACGGTCACCGTCTCCTCA |
| 714. | ME06E10-L | murine | aa | ELVMTQSPSSLSASLGERVSLTCRASQEISGYLSWLQQKPDGTIKRLIYAASTLDSGVPKRFSGS RSGSDYSLTISSLESEDFADYYCLQYASSPYTFGGGTKLEIK |
| 715. | ME06E10-LCDR1 | murine | aa | RASQEISGYLS |
| 716. | ME06E10-LCDR2 | murine | aa | AASTLDS |
| 717. | ME06E10-LCDR3 | murine | aa | LQYASSPYT |
| 718. | ME06E10-L | murine | nt | GAGCTCGTCATGACCCAGTCTCCATCCTCCTTATCTGCCTCTCTGGGAGAAAGAGTCAGTCTCAC TTGTCGGGCAAGTCAGGAAATTAGTGGTTACTTAAGCTGGCTTCAGCAGAAACCAGATGGAACTA TTAAACGCCTGATCTACGCCGCATCCACTTTAGATTCTGGTGTCCCAAAAAGGTTCAGTGGCAGT AGGTCTGGGTCAGATTATTCTCTCACCATCAGCAGCCTTGAGTCTGAAGATTTTGCAGACTATTA CTGTCTACAATATGCTAGTTCTCCGTACACGTTCGGAGGGGGGACCAAGCTTGAGATCAAA |
| 719. | ME06E10-HL | murine | aa | EVQLLEQSGADLVRPGTSVKLSCKAAGYTFSRYWISWIRQRPGHGLEWIGEIYPGGGYGNYNENF KDKVTLTADTSSSTAYMQLSSLTSEDSAIYYCARSGYDYGSKYDYYGLDYWGQGTTVTVSSGGGG SGGGGSGGGGSELVMTQSPSSLSASLGERVSLTCRASQEISGYLSWLQQKPDGTIKRLIYAASTL DSGVPKRFSGSRSGSDYSLTISSLESEDFADYYCLQYASSPYTFGGGTKLEIK |
| 720. | ME06E10-HL | murine | nt | GAGGTGCAGCTGCTCGAGCAGTCTGGAGCTGACCTGGTAAGGCCTGGGACTTCAGTGAAGCTGTC CTGCAAGGCTGCTGGATACACCTTCAGTAGGTATTGGATAAGTTGGATAAGGCAGAGGCCTGGAC ATGGGCTTGAGTGGATTGGAGAAATTTACCCTGGAGGTGGTTATGGTAACTACAATGAGAATTTC AAGGACAAGGTCACACTGACTGCAGACACATCCTCCAGCACAGCCTATATGCAGCTCAGCAGCCT GACATCTGAGGACTCTGCCATCTATTATTGTGCAAGATCGGGGTATGACTACGGCAGTAAGTACG ATTATTATGGTTTGGACTACTGGGGCCAAGGGACCACGGTCACCGTCTCCTCAGGTGGTGGTGGT TCTGGCGGCGGCGGCTCCGGTGGTGGTGGTTCTGAGCTCGTCATGACCCAGTCTCCATCCTCCTT ATCTGCCTCTCTGGGAGAAAGAGTCAGTCTCACTTGTCGGGCAAGTCAGGAAATTAGTGGTTACT TAAGCTGGCTTCAGCAGAAACCAGATGGAACTATTAAACGCCTGATCTACGCCGCATCCACTTTA GATTCTGGTGTCCCAAAAAGGTTCAGTGGCAGTAGGTCTGGGTCAGATTATTCTCTCACCATCAG CAGCCTTGAGTCTGAAGATTTTGCAGACTATTACTGTCTACAATATGCTAGTTCTCCGTACACGT TCGGAGGGGGGACCAAGCTTGAGATCAAA |
| 721. | ME06E10-HL x I2C HL | murine | aa | EVQLLEQSGADLVRPGTSVKLSCKAAGYTFSRYWISWIRQRPGHGLEWIGEIYPGGGYGNYNENF KDKVTLTADTSSSTAYMQLSSLTSEDSAIYYCARSGYDYGSKYDYYGLDYWGQGTTVTVSSGGGG SGGGGSGGGGSELVMTQSPSSLSASLGERVSLTCRASQEISGYLSWLQQKPDGTIKRLIYAASTL DSGVPKRFSGSRSGSDYSLTISSLESEDFADYYCLQYASSPYTFGGGTKLEIKSGGGGSEVQLVE SGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSG |

| SEQ ID NO. | DESIGNATION | SOURCE | TYPE | SEQUENCE |
|---|---|---|---|---|
| | | | | GGGSQTVVTQEPSLTVSPGGTVTLTCGSSTGAVTSGNYPNWVQQKPGQAPRGLIGGTKFLAPGTP ARFSGSLLGGKAALTLSGVQPEDEAEYYCVLWYSNRWVFGGGTKLTVL |
| 722. | ME06E10-HL x I2C HL | murine | nt | GAGGTGCAGCTGCTCGAGCAGTCTGGAGCTGACCTGGTAAGGCCTGGGACTTCAGTGAAGCTGTC CTGCAAGGCTGCTGGATACACCTTCAGTAGGTATTGGATAAGGTCAGAGGCCTGGAC ATGGCCTTGAGTGGATTGGAGAAATTTACCCTGGAGGTGGTTATGGTAACTACAATGAGAATTTC AAGGACAAGGTCACACTGACTGCAGACACATCCTCCAGCACAGCCTATATGCAGCTCAGCAGCCT GACATCTGAGGACTCTGCCATCTATTATTGTGCAAGATCGGGGTATGACTACGGCAGTAAGTACG ATTATTATGGTTTGGACTACTGGGGCCAAGGGACCACGGTCACCGTCTCCTCAGGTGGTGGTGGT TCTGGCGGCGGCGGCTCCGGTGGTGGTGGTTCTGAGCTCGTCATGACCCAGTCTCCATCCTCCTT ATCTGCCTCTCTGGGAGAAAGAGTCAGTCTCACTTGTCGGGCAAGTCAGGAAATTAGTGGTTACT TAAGCTGGCTTCAGCAGAAACCAGATGGAACTATTAAACGCCTGATCTACGCCGCATCCACTTTA GATTCTGGTGTCCCAAAAAGGTTCAGTGGCAGTAGGTCTGGGTCAGATTATTCTCTCACCATCAG CAGCCTTGAGTCTGAAGATTTTGCAGACTATTACTGTCTACAATATGCTAGTTCTCCGTACACGT TCGGAGGGGGGACCAAGCTTGAGATCAAATCCGGAGGTGGTGGATCCGAGGTGCAGCTGGTCGAG TCTGGAGGAGGATTGGTGCAGCCTGGAGGGTCATTGAAACTCTCATGTGCAGCCTCTGGATTCAC CTTCAATAAGTACGCCATGAACTGGGTCCGCCAGGCTCCAGGAAAGGGTTTGGAATGGGTTGCTC GCATAAGAAGTAAATATAATAATTATGCAACATATTATGCCGATTCAGTGAAAGACAGGTTCACC ATCTCCAGAGATGATTCAAAAAACACTGCCTATCTACAAATGAACAACTTGAAAACTGAGGACAC TGCCGTGTACTACTGTGTGAGACATGGGAACTTCGGTAATAGCTACATATCCTACTGGGCTTACT GGGGCCAAGGGACTCTGGTCACCGTCTCCTCAGGTGGTGGTGGTTCTGGCGGCGGCGGCTCCGGT GGTGGTGGTTCTCAGACTGTTGTGACTCAGGAACCTTCACTCACCGTATCACCTGGTGGACAGT CACACTCACTTGTGGCTCCTCGACTGGGGCTGTTACATCTGGCAACTACCCAAACTGGGTCCAAC AAAAACCAGGTCAGGCACCCCGTGGTCTAATAGGTGGGACTAAGTTCCTCGCCCCCGGTACTCCT GCCAGATTCTCAGGCTCCCTGCTTGGAGGCAAGGCTGCCCTCACCCTCTCAGGGGTACAGCCAGA GGATGAGGCAGAATATTACTGTGTTCTATGGTACAGCAACCGCTGGGTGTTCGGTGGAGGAACCA AACTGACTGTCCTA |
| 723. | ME06F2-H | murine | aa | EVQLLEQSGAELMKPGASVKISCKATGYTFSNYWIGWVKQRPGHGLEWIGDIYPGGSYTNYNEKF KGKVTLTADTSSRTAYMQLSSLTFEDSAIYYCARSGYDYASDYDYHGMDYWGQGTTVTVSS |
| 724. | ME06F2-HCDR1 | murine | aa | NYWIG |
| 725. | ME06F2-HCDR2 | murine | aa | DIYPGGSYTNYNEKFKG |
| 726. | ME06F2-HCDR3 | murine | aa | SGYDYASDYDYHGMDY |
| 727. | ME06F2-H | murine | nt | GAGGTGCAGCTGCTCGAGCAGTCTGGAGCTGAGCTGATGAAGCCTGGGGCCTCAGTGAAGATATC CTGCAAGGCTACTGGATACACCTTCAGTAATTACTGGATAGGTTGGGTAAAGCAGAGGCCTGGAC ATGGCCTTGAGTGGATTGGAGATATTTACCCTGGAGGTAGTTATACTAACTACAATGAGAATTC AAGGGCAAGGTCACACTGACTGCAGACACATCCTCCAGGACAGCCTACATGCAGCTCAGCAGCCT GACATTTGAGGACTCTGCCATCTATTACTGTGCAAGATCGGGGTATGACTACGCTAGTGACTACG ATTACCATGGTATGGACTACTGGGGCCAAGGGACCACGGTCACCGTCTCCTCA |
| 728. | ME06F2-L | murine | aa | ELVLTQSPSSMSASLGDRITITCQATQDIVKNLNWYQQKPGKPPSFLIYYATELAEGVPSRFSGS GSGSDYSLTISNLESEDFADYYCLQFYEFPYTFGGGTKLEIK |
| 729. | ME06F2-LCDR1 | murine | aa | QATQDIVKNLN |
| 730. | ME06F2-LCDR2 | murine | aa | YATELAE |
| 731. | ME06F2-LCDR3 | murine | aa | LQFYEFPYT |
| 732. | ME06F2-L | murine | nt | GAGCTCGTGCTCACCCAGTCTCCATCCTCTATGTCTGCATCTCTGGGAGACAGAATAACCATCAC TTGCCAGGCAACTCAAGACATTGTTAAGAATTTAAACTGGTATCAGCAGAAACCAGGGAAACCCC CTTCATTCCTGATCTATTATGCAACTGAACTGGCAGAAGGGGTCCCATCAAGGTTCAGTGGCAGT GGGTCTGGGTCAGACTATTCTCTGACAATCAGCAACCTGGAGTCTGAAGATTTTGCAGACTATTA CTGTCTACAGTTTTATGAGTTTCCGTACACGTTCGGAGGGGGGACCAAGCTTGAGATCAAA |
| 733. | ME06F2-HL | murine | aa | EVQLLEQSGAELMKPGASVKISCKATGYTFSNYWIGWVKQRPGHGLEWIGDIYPGGSYTNYNEKF KGKVTLTADTSSRTAYMQLSSLTFEDSAIYYCARSGYDYASDYDYHGMDYWGQGTTVTVSSGGGG SGGGGSGGGGSELVLTQSPSSMSASLGDRITITCQATQDIVKNLNWYQQKPGKPPSFLIYYATEL AEGVPSRFSGSGSGSDYSLTISNLESEDFADYYCLQFYEFPYTFGGGTKLEIK |
| 734. | ME06F2-HL | murine | nt | GAGGTGCAGCTGCTCGAGCAGTCTGGAGCTGAGCTGATGAAGCCTGGGGCCTCAGTGAAGATATC CTGCAAGGCTACTGGATACACCTTCAGTAATTACTGGATAGGTTGGGTAAAGCAGAGGCCTGGAC ATGGCCTTGAGTGGATTGGAGATATTTACCCTGGAGGTAGTTATACTAACTACAATGAGAATTC AAGGGCAAGGTCACACTGACTGCAGACACATCCTCCAGGACAGCCTACATGCAGCTCAGCAGCCT GACATTTGAGGACTCTGCCATCTATTACTGTGCAAGATCGGGGTATGACTACGCTAGTGACTACG ATTACCATGGTATGGACTACTGGGGCCAAGGGACCACGGTCACCGTCTCCTCAGGTGGTGGTGGT TCTGGCGGCGGCGGCTCCGGTGGTGGTGGTTCTGAGCTCGTGCTCACCCAGTCTCCATCCTCTAT GTCTGCATCTCTGGGAGACAGAATAACCATCACTTGCCAGGCAACTCAAGACATTGTTAAGAATT TAAACTGGTATCAGCAGAAACCAGGGAAACCCCCTTCATTCCTGATCTATTATGCAACTGAACTG GCAGAAGGGGTCCCATCAAGGTTCAGTGGCAGTGGGTCTGGGTCAGACTATTCTCTGACAATCAG |

| SEQ ID NO. | DESIGNATION | SOURCE | TYPE | SEQUENCE |
|---|---|---|---|---|
| | | | | CAACCTGGAGTCTGAAGATTTTGCAGACTATTACTGTCTACAGTTTTATGAGTTTCCGTACACGT TCGGAGGGGGGACCAAGCTTGAGATCAAA |
| 735. | ME06F2 HL x I2C HL | murine | aa | EVQLLEQSGAELMKPGASVKISCKATGYTFSNYWIGWVKQRPGHGLEWIGDIYPGGSYTNYNEKF KGKVTLTADTSSRTAYMQLSSLTFEDSAIYYCARSGYDYASDYDYHGMDYWGQGTTVTVSSGGGG SGGGGSGGGGSELVLTQSPSSMSASLGDRITITCQATQDIVKNLNWYQQKPGKPPSFLIYYATEL AEGVPSRFSGSGSGSDYSLTISNLESEDFADYYCLQFYEPPYTFGGGTKLEIKSGGGGSEVQLVE SGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSG GGGSQTVVTQEPSLTVSPGGTVTLTCGSSTGAVTSGNYPNWVQQKPGQAPRGLIGGTKFLAPGTP ARFSGSLLGGKAALTLSGVQPEDEAEYYCVLWYSNRWVFGGGTKLTVL |
| 736. | ME06F2 HL x I2C HL | murine | nt | GAGGTGCAGCTGCTCGAGCAGTCTGGAGCTGAGCTGATGAAGCCTGGGGCCTCAGTGAAGATATC CTGCAAGGCTACTGGATACACCTTCAGTAATTACTGGATAGGTTGGGTAAAGCAGAGGCCTGGAC ATGGCCTTGAGTGGATTGGAGATATTTACCCTGGAGGTAGTTATACTAACTACAATGAGAAATTC AAGGGCAAGGTCACACTGACTGCAGACACATCCTCCAGGACAGCCTACATGCAGCTCAGCAGCCT GACATTTGAGGACTCTGCCATCTATTACTGTGCAAGATCGGGGTATGACTACGCTAGTGACTACG ATTACCATGGTATGGACTACTGGGGCCAAGGGACCACGGTCACCGTCTCCTCAGGTGGTGGTGGT TCTGGCGGCGGCGGCTCCGGTGGTGGTGGTTCTGAGCTCGTGCTCACCCAGTCTCCATCCTCTAT GTCTGCATCTCTGGGAGACAGAATAACCATCACTTGCCAGGCAACTCAAGACATTGTTAAGAATT TAAACTGGTATCAGCAGAAACCAGGGAAACCCCCTTCATTCCTGATCTATTATGCAACTGAACTG GCAGAAGGGGTCCCATCAAGGTTCAGTGGCAGTGGGTCTGGGTCAGACTATTCTCTGACAATCAG CAACCTGGAGTCTGAAGATTTTGCAGACTATTACTGTCTACAGTTTTATGAGTTTCCGTACACGT TCGGAGGGGGGACCAAGCTTGAGATCAAATCCGAGGTGGTGGATCCGAGGTGCAGCTGGTCGAG TCTGGAGGAGGATTGGTGCAGCCTGGAGGGTCATTGAAACTCTCATGTGCAGCCTCTGGATTCAC CTTCAATAAGTACGCCATGAACTGGGTCCGCCAGGCTCCAGGAAAGGGTTTGGAATGGGTTGCTC GCATAAGAAGTAAATATAATAATTATGCAACATATTATGCCGATTCAGTGAAAGACAGGTTCACC ATCTCCAGAGATGATTCAAAAAACACTGCCTATCTACAAATGAACAACTTGAAAACTGAGGACAC TGCCGTGTACTACTGTGTGAGACATGGGAACTTCGGTAATAGCTACATATCCTACTGGGCTTACT GGGGCCAAGGGACTCTGGTCACCGTCTCCTCAGGTGGTGGTGGTTCTGGCGGCGGCGGCTCCGGT GGTGGTGGTTCTCAGACTGTTGTGACTCAGGAACCTTCACTCACCGTATCACCTGGTGGAACAGT CACACTCACTTGTGGCTCCTCGACTGGGGCTGTTACATCTGGCAACTACCCAAACTGGGTCCAAC AAAAACCAGGTCAGGCACCCCGTGGTCTAATAGGTGGGACTAAGTTCCTCGCCCCCGGTACTCCT GCCAGATTCTCAGGCTCCCTGCTTGGAGGCAAGGCTGCCCTCACCCTCTCAGGGGTACAGCCAGA GGATGAGGCAGAATATTACTGTGTTCTATGGTACAGCAACCGCTGGGTGTTCGGTGGAGGAACCA AACTGACTGTCCTA |
| 737. | FA22A9-H | artficial | aa | QVQLVQSGAEVKKPGASVKVSCKTSGYTFTEYTIHWVRQAPGQRLEWMGGINPNNGIPNYNQKFK GRVTITIDTSSSTAYMELSSLRSEDTAVYYCARRRIAYGYDEGHAMDYWGQGTLVTVSS |
| 738. | FA22A9-HCDR1 | artificial | aa | EYTIH |
| 739. | FA22A9-HCDR2 | artificial | aa | GINPNNGIPNYNQKFKG |
| 740. | FA22A9-HCDR3 | artificial | aa | RRIAYGYDEGHAMDY |
| 741. | FA22A9-H | artificial | nt | CAGGTGCAGCTGGTCCAGTCTGGAGCTGAGGTGAAGAAGCCTGGGGCTTCAGTAAAGGTGTCCTG CAAGACTTCTGGATACACATTCACTGAATACACCATACACTGGGTGAGACAGGCCCCTGGACAGA GACTTGAGTGGATGGGAGGTATTAATCCTAACAATGGTATTCCTAACTACAATCAGAAGTTCAAG GGCAGGGTCACAATAACTATAGACACGTCCTCCAGCACCGCCTACATGGAGCTCAGCAGCCTGAG ATCTGAGGATACTGCCGTCTATTACTGTGCAAGAAGAAGAATCGCCTATGGTTACGACGAGGGCC ATGCTATGGACTACTGGGGTCAAGGAACCCTGGTCACCGTCTCCTCA |
| 742. | FA22A9-L | artificial | aa | DIVMTQTPLSLAVTVGETASMSCKSSQSLLYSRNQKNYLAWYLQKPGQSPQLLIYWASTRESGVP DRFSGSGSGTDFTLTISRVEAEDVGVYYCQQYFSYPLTFGGGTKVEIK |
| 743. | FA22A9-LCDR1 | artificial | aa | KSSQSLLYSRNQKNYLA |
| 744. | FA22A9-LCDR2 | artificial | aa | WASTRES |
| 745. | FA22A9-LCDR3 | artificial | aa | QQYFSYPLT |
| 746. | FA22A9-L | artificial | nt | GACATCGTGATGACACAGACTCCACTCTCCCTAGCTGTGACAGTTGGAGAGACGGCTTCTATGAG CTGCAAGTCCAGTCAGAGCCTTTTATATAGTCGTAATCAAAAGAACTACTTGGCCTGGTACCTGC AGAAGCCAGGGCAGTCTCCTCAACTGCTGATTTACTGGGCATCCACTAGGGAATCTGGGGTCCCT GATCGCTTCTCAGGCAGTGGATCTGGGACGGATTTCACTCTCACGATCAGCAGAGTGGAGGCTGA GGACGTGGGAGTTTATTACTGTCAGCAATATTTTAGCTATCCGCTCACGTTCGGTGGTGGGACCA AGGTGGAGATCAAA |
| 747. | FA22A9-HL | artficial | aa | QVQLVQSGAEVKKPGASVKVSCKTSGYTFTEYTIHWVRQAPGQRLEWMGGINPNNGIPNYNQKFK GRVTITIDTSSSTAYMELSSLRSEDTAVYYCARRRIAYGYDEGHAMDYWGQGTLVTVSSGGGGSG GGGSGGGGSDIVMTQTPLSLAVTVGETASMSCKSSQSLLYSRNQKNYLAWYLQKPGQSPQLLIYW ASTRESGVPDRFSGSGSGTDFTLTISRVEAEDVGVYYCQQYFSYPLTFGGGTKVEIK |

| SEQ ID NO. | DESIGNATION | SOURCE | TYPE | SEQUENCE |
|---|---|---|---|---|
| 748. | FA22A9-HL | artificial | nt | CAGGTGCAGCTGGTCCAGTCTGGAGCTGAGGTGAAGAAGCCTGGGGCTTCAGTAAAGGTGTCCTG<br>CAAGACTTCTGGATACACATTCACTGAATACACCATACACTGGGTGAGACAGGCCCCTGGACAGA<br>GACTTGAGTGGATGGGAGGTATTAATCCTAACAATGGTATTCCTAACTACAATCAGAAGTTCAAG<br>GGCAGGGTCACAATAACTATAGACACGTCCTCCAGCACCGCCTACATGGAGCTCAGCAGCCTGAG<br>ATCTGAGGATACTGCGGTCTATTACTGTGCAAGAAGAAGAATCGCCTATGGTTACGACGAGGGCC<br>ATGCTATGGACTACTGGGGTCAAGGAACCCTGGTCACCGTCTCCTCAGGTGGTGGTGGTTCTGGC<br>GGCGGCGGCTCCGGTGGTGGTGGTTCTGACATCGTGATGACACAGACTCCACTCTCCCTAGCTGT<br>GACAGTTGGAGAGACGGCTTCTATGAGCTGCAAGTCCAGTCAGAGCCTTTTATATAGTCGTAATC<br>AAAAGAACTACTTGGCCTGGTACCTGCAGAAGCCAGGGCAGTCTCCTCAACTGCTGATTTACTGG<br>GCATCCACTAGGGAATCTGGGGTCCCTGATCGCTTCTCAGGCAGTGGATCTGGGACGGATTTCAC<br>TCTCACGATCAGCAGAGTGGAGGCTGAGGACGTGGGAGTTTATTACTGTCAGCAATATTTTAGCT<br>ATCCGCTCACGTTCGGTGGTGGGACCAAGGTGGAGATCAAA |
| 749. | FA22A9 HL x I2C HL | artificial | aa | QVQLVQSGAEVKKPGASVKVSCKTSGYTFTEYTIHWVRQAPGQRLEWMGGINPNNGIPNYNQKFK<br>GRVTITIDTSSSTAYMELSSLRSEDTAVYYCARRRIAYGYDEGHAMDYWGQGTLVTVSSGGGGSG<br>GGGSGGGGSDIVMTQTPLSLAVTVGETASMSCKSSQSLLYSRNQKNYLAWYLQKPGQSPQLLIYW<br>ASTRESGVPDRFSGSGSGTDFTLTISRVEAEDVGVYYCQQYFSYPLTFGGGTKVEIKSGGGGSEV<br>QLVESGGGLVQPGGSLKLSCAASGETENKYAMNWVRQAPGKGLEWVARIRSKYNNYATYYADSVK<br>DRFTISRDDSKNTAYLQMNNLKTEDTAVYYCVRHGNFGNSYISYWAYWGQGTLVTVSSGGGGSGG<br>GGSGGGGSQTVVTQEPSLTVSPGGTVTLTCGSSTGAVTSGNYPNWVQQKPGQAPRGLIGGTKFLA<br>PGTPARFSGSLLGGKAALTLSGVQPEDEAEYYCVLWYSNRWVFGGGTKLTVL |
| 750. | FA22A9 HL x I2C HL | artificial | nt | CAGGTGCAGCTGGTCCAGTCTGGAGCTGAGGTGAAGAAGCCTGGGGCTTCAGTAAAGGTGTCCTG<br>CAAGACTTCTGGATACACATTCACTGAATACACCATACACTGGGTGAGACAGGCCCCTGGACAGA<br>GACTTGAGTGGATGGGAGGTATTAATCCTAACAATGGTATTCCTAACTACAATCAGAAGTTCAAG<br>GGCAGGGTCACAATAACTATAGACACGTCCTCCAGCACCGCCTACATGGAGCTCAGCAGCCTGAG<br>ATCTGAGGATACTGCGGTCTATTACTGTGCAAGAAGAAGAATCGCCTATGGTTACGACGAGGGCC<br>ATGCTATGGACTACTGGGGTCAAGGAACCCTGGTCACCGTCTCCTCAGGTGGTGGTGGTTCTGGC<br>GGCGGCGGCTCCGGTGGTGGTGGTTCTGACATCGTGATGACACAGACTCCACTCTCCCTAGCTGT<br>GACAGTTGGAGAGACGGCTTCTATGAGCTGCAAGTCCAGTCAGAGCCTTTTATATAGTCGTAATC<br>AAAAGAACTACTTGGCCTGGTACCTGCAGAAGCCAGGGCAGTCTCCTCAACTGCTGATTTACTGG<br>GCATCCACTAGGGAATCTGGGGTCCCTGATCGCTTCTCAGGCAGTGGATCTGGGACGGATTTCAC<br>TCTCACGATCAGCAGAGTGGAGGCTGAGGACGTGGGAGTTTATTACTGTCAGCAATATTTTAGCT<br>ATCCGCTCACGTTCGGTGGTGGGACCAAGGTGGAGATCAAATCCGGAGGTGGTGGATCCGAGGTG<br>CAGCTGGTCGAGTCTGGAGGAGGATTGGTGCAGCCTGGAGGGTCATTGAAACTCTCATGTGCAGC<br>CTCTGGATTCACCTTCAATAAGTACGCCATGAACTGGGTCCGCCAGGCTCCAGGAAAGGGTTTGG<br>AATGGGTTGCTCGCATAAGAAGTAAATATAATAATTATGCAACATATTATGCCGATTCAGTGAAA<br>GACAGGTTCACCATCTCCAGAGATGATTCAAAAAACACTGCCTATCTACAAATGAACAACTTGAA<br>AACTGAGGACACTGCCGTGTACTACTGTGTGAGACATGGGAACTTCGGTAATAGCTACATATCCT<br>ACTGGGCTTACTGGGGCCAAGGGACTCTGGTCACCGTCTCCTCAGGTGGTGGTGGTTCTGGCGGC<br>GGCGGCTCCGGTGGTGGTGGTTCTCAGACTGTTGTGACTCAGGAACCTTCACTCACCGTATCACC<br>TGGTGGAACAGTCACACTCACTTGTGGCTCCTCGACTGGGGCTGTTACATCTGGCAACTACCCAA<br>ACTGGGTCCAACAAAAACCAGGTCAGGCACCCCGTGGTCTAATAGGTGGGACTAAGTTCCTCGCC<br>CCCGGTACTCCTGCCAGATTCTCAGGCTCCCTGCTTGGAGGCAAGGCTGCCCTCACCCTCTCAGG<br>GGTACAGCCAGAGGATGAGGCAGAATATTACTGTGTTCTATGGTACAGCAACCGCTGGGTGTTCG<br>GTGGAGGAACCAAACTGACTGTCCTA |
| 751. | FA22C11-H | artificial | aa | QVQLVQSGAEVKKPGASVKVSCKTSGYTFTEYTIHWVRQSPGQRLEWMGGINPNNGIPNYNQKFK<br>GRVTITRDKSSSTAYMELSSLRSEDTAVYYCARRRIAYGYDEGHAMDYWGQGTLVTVSS |
| 752. | FA22C11-HCDR1 | artificial | aa | EYTIH |
| 753. | FA22C11-HCDR2 | artificial | aa | GINPNNGIPNYNQKFKG |
| 754. | FA22C11-HCDR3 | artificial | aa | RRIAYGYDEGHAMDY |
| 755. | FA22C11-H | artificial | nt | CAGGTGCAGCTGGTCCAGTCTGGAGCTGAGGTGAAGAAGCCTGGGGCTTCAGTAAAGGTGTCCTG<br>CAAGACTTCTGGATACACATTCACTGAATACACCATACACTGGGTGAGACAGAGTCCCCTGGACAGA<br>GACTTGAGTGGATGGGAGGTATTAATCCTAACAATGGTATTCCTAACTACAATCAGAAGTTCAAG<br>GGCAGGGTCACAATAACTAGAGACAAGTCCTCCAGCACCGCCTACATGGAGCTCAGCAGCCTGAG<br>ATCTGAGGATACTGCGGTCTATTACTGTGCAAGAAGAAGAATCGCCTATGGTTACGACGAGGGCC<br>ATGCTATGGACTACTGGGGTCAAGGAACCCTGGTCACCGTCTCCTCA |
| 756. | FA22C11-L | artificial | aa | DIVMTQTPLSLPVTVGEPASISCKSSQSLLYSRNQKNYLAWYLQKPGQSPQLLIYWASTRESGVP<br>DRFSGSGSGTDFTLKISRVEAEDVGIYYCQQYFSYPLTFGGGTKVEIK |
| 757. | FA22C11-LCDR1 | artificial | aa | KSSQSLLYSRNQKNYLA |
| 758. | FA22C11-LCDR2 | artificial | aa | WASTRES |
| 759. | FA22C11-LCDR3 | artificial | aa | QQYFSYPLT |
| 760. | FA22C11-L | artificial | nt | GACATCGTGATGACACAGACTCCACTCTCCCTACCTGTGACAGTTGGAGAGCCGGCTTCTATCAG<br>CTGCAAGTCCAGTCAGAGCCTTTTATATAGTCGTAATCAAAAGAACTACTTGGCCTGGTACCTGC |

| SEQ ID NO. | DESIGNATION | SOURCE | TYPE | SEQUENCE |
|---|---|---|---|---|
| | | | | AGAAGCCAGGGCAGTCTCCTCAACTGCTGATTTACTGGGCATCCACTAGGGAATCTGGGGTCCCT<br>GATCGCTTCTCAGGCAGTGGATCTGGGACAGACTTCACCCTCAAGATCTCTCGTGTGGAGGCGGA<br>GGATGTTGGAATCTATTACTGTCAGCAATATTTTAGCTATCCGCTCACGTTCGGTGGTGGGACCA<br>AGGTGGAGATCAAA |
| 761. | FA22C11-HL | artificial | aa | QVQLVQSGAEVKKPGASVKVSCKTSGYTFTEYTIHWVRQSPGQRLEWMGGINPNNGIPNYNQKFK<br>GRVTITRDKSSSTAYMELSSLRSEDTAVYYCARRRIAYGYDEGHAMDYWGQGTLVTVSSGGGGSG<br>GGGSGGGGSDIVMTQTPLSLPVTVGEPASISCKSSQSLLYSRNQKNYLAWYLQKPGQSPQLLIYW<br>ASTRESGVPDRFSGSGSGTDFTLKISRVEAEDVGIYYCQQYFSYPLTFGGGTKVEIK |
| 762. | FA22C11-HL | artificial | nt | CAGGTGCAGCTGGTCCAGTCTGGAGCTGAGGTGAAGAAGCCTGGGGCTTCAGTAAAGGTGTCCTG<br>CAAGACTTCTGGATACACATTCACTGAATACACCATACACTGGGTGAGACAGTCCCCTGGACAGA<br>GACTTGAGTGGATGGGAGGTATTAATCCTAACAATGGTATTCCTAACTACAATCAGAAGTTCAAG<br>GGCAGGGTCACAATAACTAGAGACAAGTCCTCCAGCACCGCCTACATGGAGCTCAGCAGCCTGAG<br>ATCTGAGGATACTGCGGTCTATTACTGTGCAAGAAGAAGAATCGCCTATGGTTACGACGAGGGCC<br>ATGCTATGGACTACTGGGGTCAAGGAACCCTGGTCACCGTCTCCTCAGGTGGTGGTGGTTCTGGC<br>GGCGGCGGCTCCGGTGGTGGTGGTTCTGACATCGTGATGACACAGACTCCACTCTCCCTACCTGT<br>GACAGTTGGAGAGCCGGCTTCTATCAGCTGCAAGTCCAGTCAGAGCCTTTTATATAGTCGTAATC<br>AAAAGAACTACTTGGCCTGGTACCTGCAGAAGCCAGGGCAGTCTCCTCAACTGCTGATTTACTGG<br>GCATCCACTAGGGAATCTGGGGTCCCTGATCGCTTCTCAGGCAGTGGATCTGGGACAGACTTCAC<br>CCTCAAGATCTCTCGTGTGGAGGCGGAGGATGTTGGAATCTATTACTGTCAGCAATATTTTAGCT<br>ATCCGCTCACGTTCGGTGGTGGGACCAAGGTGGAGATCAAA |
| 763. | FA22C11 HL x I2C HL | artificial | aa | QVQLVQSGAEVKKPGASVKVSCKTSGYTFTEYTIHWVRQSPGQRLEWMGGINPNNGIPNYNQKFK<br>GRVTITRDKSSSTAYMELSSLRSEDTAVYYCARRRIAYGYDEGHAMDYWGQGTLVTVSSGGGGSG<br>GGGSGGGGSDIVMTQTPLSLPVTVGEPASISCKSSQSLLYSRNQKNYLAWYLQKPGQSPQLLIYW<br>ASTRESGVPDRFSGSGSGTDFTLKISRVEAEDVGIYYCQQYFSYPLTFGGGTKVEIKSGGGGSEV<br>QLVESGGGLVQPGGSLKLSCAASGFTFNKYAMNWVRQAPGKGLEWVARIRSKYNNYATYYADSVK<br>DRFTISRDDSKNTAYLQMNNLKTEDTAVYYCVRHGNFGNSYISYWAYWGQGTLVTVSSGGGGSGG<br>GGSGGGGSQTVVTQEPSLTVSPGGTVTLTCGSSTGAVTSGNYPNWVQQKPGQAPRGLIGGTKFLA<br>PGTPARFSGSLLGGKAALTLSGVQPEDEAEYYCVLWYSNRWVFGGGTKLTVL |
| 764. | FA22C11 HL x I2C HL | artificial | nt | CAGGTGCAGCTGGTCCAGTCTGGAGCTGAGGTGAAGAAGCCTGGGGCTTCAGTAAAGGTGTCCTG<br>CAAGACTTCTGGATACACATTCACTGAATACACCATACACTGGGTGAGACAGTCCCCTGGACAGA<br>GACTTGAGTGGATGGGAGGTATTAATCCTAACAATGGTATTCCTAACTACAATCAGAAGTTCAAG<br>GGCAGGGTCACAATAACTAGAGACAAGTCCTCCAGCACCGCCTACATGGAGCTCAGCAGCCTGAG<br>ATCTGAGGATACTGCGGTCTATTACTGTGCAAGAAGAAGAATCGCCTATGGTTACGACGAGGGCC<br>ATGCTATGGACTACTGGGGTCAAGGAACCCTGGTCACCGTCTCCTCAGGTGGTGGTGGTTCTGGC<br>GGCGGCGGCTCCGGTGGTGGTGGTTCTGACATCGTGATGACACAGACTCCACTCTCCCTACCTGT<br>GACAGTTGGAGAGCCGGCTTCTATCAGCTGCAAGTCCAGTCAGAGCCTTTTATATAGTCGTAATC<br>AAAAGAACTACTTGGCCTGGTACCTGCAGAAGCCAGGGCAGTCTCCTCAACTGCTGATTTACTGG<br>GCATCCACTAGGGAATCTGGGGTCCCTGATCGCTTCTCAGGCAGTGGATCTGGGACAGACTTCAC<br>CCTCAAGATCTCTCGTGTGGAGGCGGAGGATGTTGGAATCTATTACTGTCAGCAATATTTTAGCT<br>ATCCGCTCACGTTCGGTGGTGGGACCAAGGTGGAGATCAAATCCGGAGGTGGTGGATCCGAGGTG<br>CAGCTGGTCGAGTCTGGAGGAGGATTGGTGCAGCCTGGAGGGTCATTGAAACTCTCATGTGCAGC<br>CTCTGGATTCACCTTCAATAAGTACGCCATGAACTGGGTCCGCCAGGCTCCAGGAAAGGGTTTGG<br>AATGGGTTGCTCGCATAAGAAGTAAATATAATTATGCAACATATTATGCCGATTCAGTGAAA<br>GACAGGTTCACCATCTCCAGAGATGATTCAAAAAACACTGCCTATCTACAAATGAACAACTTGAA<br>AACTGAGGACACTGCCGTGTACTACTGTGTGAGACATGGGAACTTCGGTAATAGCTACATATCCT<br>ACTGGGCTTACTGGGGCCAAGGGACTCTGGTCACCGTCTCCTCAGGTGGTGGTGGTTCTGGCGGC<br>GGCGGCTCCGGTGGTGGTGGTTCTCAGACTGTTGTGACTCAGGAACCTTCACTCACCGTATCACC<br>TGGTGGAACAGTCACACTCACTTGTGGCTCCTCGACTGGGGCTGTTACATCGGCAACTACCCAA<br>ACTGGGTCCAACAAAAACCAGGTCAGGCACCCCGTGGTCTAATAGGTGGGACTAAGTTCCTCGCC<br>CCCGGTACTCCTGCCAGATTCTCAGGCTCCCTGCTTGGAGGCAAGGCTGCCCTCACCCTCTCAGG<br>GGTACAGCCAGAGGATGAGGCAGAATATTACTGTGTTCTATGGTACAGCAACCGCTGGGTGTTCG<br>GTGGAGGAACCAAACTGACTGTCCTA |
| 765. | FA22D8-H | artificial | aa | QVQLVQSGAEVEKPGASVKVSCKASGYTFTEYTIHWVRQAPGQRLEWMGGINPNNGIPNYNQKFK<br>GRATITIDTSSSTAYMELSSLTSEDTAVYYCARRRIAYGYDEGHAMDYWGQGTLVTVSS |
| 766. | FA22D8-HCDR1 | artificial | aa | EYTIH |
| 767. | FA22D8-HCDR2 | artificial | aa | GINPNNGIPNYNQKFKG |
| 768. | FA22D8-HCDR3 | artificial | aa | RRIAYGYDEGHAMDY |
| 769. | FA22D8-H | artificial | nt | CAGGTGCAGCTGGTCCAGTCTGGAGCTGAGGTGGAGAAGCCTGGGGCTTCAGTAAAGGTGTCCTG<br>CAAGGCTTCTGGATACACATTCACTGAATACACCATACACTGGGTGAGACAGGCCCCTGGACAGA<br>GACTTGAGTGGATGGGAGGTATTAATCCTAACAATGGTATTCCTAACTACAATCAGAAGTTCAAG<br>GGCAGGGCCACAATAACTATAGACACGTCCTCCAGCACCGCCTACATGGAGCTCAGCAGCCTGAC<br>ATCTGAGGATACTGCGGTCTATTACTGTGCAAGAAGAAGAATCGCCTATGGTTACGACGAGGGCC<br>ATGCTATGGACTACTGGGGTCAAGGAACCCTGGTCACCGTCTCCTCA |
| 770. | FA22D8-L | artificial | aa | DIVMTQTPLSLPVTVGEQASISCKSSQSLLYSRNQKNYLAWYLQKPGQSPKLLIYWASTRESGVP<br>DRFSGSGSGTDFTLKISSVEAEDVGVYYCQQYFSYPLTFGGGTKVEIK |

| SEQ ID NO. | DESIGNATION | SOURCE | TYPE | SEQUENCE |
|---|---|---|---|---|
| 771. | FA22D8-LCDR1 | artificial | aa | KSSQSLLYSRNQKNYLA |
| 772. | FA22D8-LCDR2 | artificial | aa | WASTRES |
| 773. | FA22D8-LCDR3 | artificial | aa | QQYFSYPLT |
| 774. | FA22D8-L | artificial | nt | GACATCGTGATGACACAGACTCCACTCTCCCTACCTGTGACAGTTGGAGAGCAGGCTTCTATCAG CTGCAAGTCCAGTCAGAGCCTTTTATATAGTCGTAATCAAAAGAACTACTTGGCCTGGTACCTGC AGAAGCCAGGGCAGTCTCCTAAACTGCTGATTTACTGGGCATCCACTAGGGAATCTGGGGTCCCT GATCGCTTCTCAGGCAGTGGATCTGGGACGGATTTCACTCTCAAGATCAGCAGTGTGGAGGCTGA GGATGTTGGAGTCTATTACTGTCAGCAATATTTTAGCTATCCGCTCACGTTCGGTGGTGGGACCA AGGTGGAGATCAAA |
| 775. | FA22D8-HL | artificial | aa | QVQLVQSGAEVEKPGASVKVSCKASGYTFTEYTIHWVRQAPGQRLEWMGGINPNNGIPNYNQKFK GRATITIDTSSSTAYMELSSLTSEDTAVYYCARRRIAYGYDEGHAMDYWGQGTLVTVSSGGGGSG GGGSGGGGSDIVMTQTPLSLPVTVGEQASISCKSSQSLLYSRNQKNYLAWYLQKPGQSPKLLIYW ASTRESGVPDRFSGSGSGTDFTLKISSVEAEDVGVYYCQQYFSYPLTFGGGTKVEIK |
| 776. | FA22D8-HL | artificial | nt | CAGGTGCAGCTGGTCCAGTCTGGAGCTGAGGTGGAGAAGCCTGGGGCTTCAGTAAAGGTGTCCTG CAAGGCTTCTGGATACACATTCACTGAATACACCATACACTGGGTGAGACAGGCCCCTGGACAGA GACTTGAGTGGATGGGAGGTATTAATCCTAACAATGGTATTCCTAACTACAATCAGAAGTTCAAG GGCAGGGCCACAATAACTATAGACACGTCCTCCAGCACCGCCTACATGGAGCTCAGCAGCCTGAC ATCTGAGGATACTGCGGTCTATTACTGTGCAAGAAGAATCGCCTATGGTTACGACGAGGGCC ATGCTATGGACTACTGGGGTCAAGGAACCCTGGTCACCGTCTCCTCAGGTGGTGGTGGTTCTGGC GGCGGCGGCTCCGGTGGTGGTGGTTCTGACATCGTGATGACACAGACTCCACTCTCCCTACCTGT GACAGTTGGAGAGCAGGCTTCTATCAGCTGCAAGTCCAGTCAGAGCCTTTTATATAGTCGTAATC AAAAGAACTACTTGGCCTGGTACCTGCAGAAGCCAGGGCAGTCTCCTAAACTGCTGATTTACTGG GCATCCACTAGGGAATCTGGGGTCCCTGATCGCTTCTCAGGCAGTGGATCTGGGACGGATTTCAC TCTCAAGATCAGCAGTGTGGAGGCTGAGGATGTTGGAGTCTATTACTGTCAGCAATATTTTAGCT ATCCGCTCACGTTCGGTGGTGGGACCAAGGTGGAGATCAAA |
| 777. | FA22D8 HL x I2C HL | artificial | nt | QVQLVQSGAEVEKPGASVKVSCKASGYTFTEYTIHWVRQAPGQRLEWMGGINPNNGIPNYNQKFK GRATITIDTSSSTAYMELSSLTSEDTAVYYCARRRIAYGYDEGHAMDYWGQGTLVTVSSGGGGSG GGGSGGGGSDIVMTQTPLSLPVTVGEQASISCKSSQSLLYSRNQKNYLAWYLQKPGQSPKLLIYW ASTRESGVPDRFSGSGSGTDFTLKISSVEAEDVGVYYCQQYFSYPLTFGGGTKVEIKSGGGGSEV QLVESGGGLVQPGGSLKLSCAASGFTFNKYAMNWVRQAPGKGLEWVARIRSKYNNYATYYADSVK DRFTISRDDSKNTAYLQMNNLKTEDTAVYYCVRHGNFGNSYISYWAYWGQGTLVTVSSGGGGSGG GGSGGGGSQTVVTQEPSLTVSPGGTVTLTCGSSTGAVTSGNYPNWVQQKPGQAPRGLIGGTKFLA PGTPARFSGSLLGGKAALTLSGVQPEDEAEYYCVLWYSNRWVFGGGTKLTVL |
| 778. | FA22D8 HL x I2C HL | artificial | nt | CAGGTGCAGCTGGTCCAGTCTGGAGCTGAGGTGGAGAAGCCTGGGGCTTCAGTAAAGGTGTCCTG CAAGGCTTCTGGATACACATTCACTGAATACACCATACACTGGGTGAGACAGGCCCCTGGACAGA GACTTGAGTGGATGGGAGGTATTAATCCTAACAATGGTATTCCTAACTACAATCAGAAGTTCAAG GGCAGGGCCACAATAACTATAGACACGTCCTCCAGCACCGCCTACATGGAGCTCAGCAGCCTGAC ATCTGAGGATACTGCGGTCTATTACTGTGCAAGAAGAAGAATCGCCTATGGTTACGACGAGGGCC ATGCTATGGACTACTGGGGTCAAGGAACCCTGGTCACCGTCTCCTCAGGTGGTGGTGGTTCTGGC GGCGGCGGCTCCGGTGGTGGTGGTTCTGACATCGTGATGACACAGACTCCACTCTCCCTACCTGT GACAGTTGGAGAGCAGGCTTCTATCAGCTGCAAGTCCAGTCAGAGCCTTTTATATAGTCGTAATC AAAAGAACTACTTGGCCTGGTACCTGCAGAAGCCAGGGCAGTCTCCTAAACTGCTGATTTACTGG GCATCCACTAGGGAATCTGGGGTCCCTGATCGCTTCTCAGGCAGTGGATCTGGGACGGATTTCAC TCTCAAGATCAGCAGTGTGGAGGCTGAGGATGTTGGAGTCTATTACTGTCAGCAATATTTTAGCT ATCCGCTCACGTTCGGTGGTGGGACCAAGGTGGAGATCAAATCCGGAGGTGGTGGATCCGAGGTG CAGCTGGTCGAGTCTGGAGGAGGATTGGTGCAGCCTGGAGGGTCATTGAAACTCTCATGTGCAGC CTCTGGATTCACCTTCAATAAGTACGCCATGAACTGGGTCCGCCAGGCTCCAGGAAAGGGTTTGG AATGGGTTGCTCGCATAAGAAGTAAATATAATAATTATGCAACATATTATGCCGATTCAGTGAAA GACAGGTTCACCATCTCCAGAGATGATTCAAAAACACTGCCTATCTACAAATGAACAACTTGAA AACTGAGGACACTGCCGTGTACTACTGTGTGAGACATGGGAACTTCGGTAATAGCTACATATCCT ACTGGGCTTACTGGGGCCAAGGGACTCTGGTCACCGTCTCCTCAGGTGGTGGTGGTTCTGGCGGC GGCGGCTCCGGTGGTGGTGGTTCTCAGACTGTTGTGACTCAGGAACCTTCACTCACCGTATCACC TGGTGGAACAGTCACACTCACTTGTGGCCTCGACTGGGCTGTTACATCGGCAACTACCCAA ACTGGGTCCAACAAAAACCAGGTCAGGCACCCCGTGGTCTAATAGGTGGGACTAAGTTCCTCGCC CCCGGTACTCCTGCCAGATTCTCAGGCTCCCTGCTTGGAGGCAAGGCTGCCCTCACCCTCTCAGG GGTACAGCCAGAGGATGAGGCAGAATATTACTGTGTTCTATGGTACAGCAACCGCTGGGTGTTCG GTGGAGGAACCAAACTGACTGTCCTA |
| 779. | FA22E8-H | artificial | aa | QVQLVQSGAELVKPGASVKVSCKASGYTFTEYTIHWVRQAPGQRLEWMGGINPNNGIPNYNQKFK GRATITIDTSASTAYMELRSLRSEDTAVYYCARRRIAYGYDEGHAMDYWGQGTLVTVSS |
| 780. | FA22E8-HCDR1 | artificial | aa | EYTIH |
| 781. | FA22E8-HCDR2 | artificial | aa | GINPNNGIPNYNQKFKG |
| 782. | FA22E8-HCDR3 | artificial | aa | RRIAYGYDEGHAMDY |

| SEQ ID NO. | DESIGNATION | SOURCE | TYPE | SEQUENCE |
|---|---|---|---|---|
| 783. | FA22E8-H | artificial | nt | CAGGTGCAGCTGGTCCAGTCTGGAGCTGAGCTGGTGAAGCCTGGGGCTTCAGTAAAGGTGTCCTG CAAGGCTTCTGGATACACATTCACTGAATACACCATACACTGGGTGAGACAGGCCCCTGGACAGA GACTTGAGTGGATGGAGGTATTAATCCTAACAATGGTATTCCTAACTACAATCAGAAGTTCAAG GGCAGGGCCACAATAACTATAGACACGTCCGCCAGCACCGCCTACATGGAGCTCCGCAGCCTGAG ATCTGAGGATACTGCGGTCTATTACTGTGCAAGAAGAAGAATCGCCTATGGTTACGACGAGGGCC ATGCTATGGACTACTGGGGTCAAGGAACCCTGGTCACCGTCTCCTCA |
| 784. | FA22E8-L | artificial | aa | DIVMTQTPLSLAVTPGEQASISCKSSQSLLYSRNQKNYLAWYLQKPGQSPQLLIYWASTRESGVP DRFSGSGFGTDFTLKISGVEAEDVGVYYCQQYFSYPLTFGGGTKVEIK |
| 785. | FA22E8-LCDR1 | artificial | aa | KSSQSLLYSRNQKNYLA |
| 786. | FA22E8-LCDR2 | artificial | aa | WASTRES |
| 787. | FA22E8-LCDR3 | artificial | aa | QQYFSYPLT |
| 788. | FA22E8-L | artificial | nt | GACATCGTGATGACACAGACTCCACTCTCCCTAGCTGTGACACCTGGAGAGCAGGCTTCTATCAG CTGCAAGTCCAGTCAGAGCCTTTTATATAGTCGTAATCAAAAGAACTACTTGGCCTGGTACCTGC AGAAGCCAGGGCAGTCTCCTCAACTGCTGATTTACTGGGCATCCACTAGGGAATCTGGGGTCCCT GATCGCTTCTCAGGCAGTGGATTTGGGACGGATTTCACTCTCAAGATCAGCGGAGTGGAGGCTGA GGACGTGGGAGTTTATTACTGTCAGCAATATTTTAGCTATCCGCTCACGTTCGGTGGTGGGACCA AGGTGGAGATCAAA |
| 789. | FA22E8-HL | artificial | aa | QVQLVQSGAELVKPGASVKVSCKASGYTFTEYTIHWVRQAPGQRLEWMGGINPNNGIPNYNQKFK GRATITIDTSASTAYMELRSLRSEDTAVYYCARRRIAYGYDEGHAMDYWGQGTLVTVSSGGGGSG GGGSGGGGSDIVMTQTPLSLAVTPGEQASISCKSSQSLLYSRNQKNYLAWYLQKPGQSPQLLIYW ASTRESGVPDRFSGSGFGTDFTLKISGVEAEDVGVYYCQQYFSYPLTFGGGTKVEIK |
| 790. | FA22E8-HL | artificial | nt | CAGGTGCAGCTGGTCCAGTCTGGAGCTGAGCTGGTGAAGCCTGGGGCTTCAGTAAAGGTGTCCTG CAAGGCTTCTGGATACACATTCACTGAATACACCATACACTGGGTGAGACAGGCCCCTGGACAGA GACTTGAGTGGATGGAGGTATTAATCCTAACAATGGTATTCCTAACTACAATCAGAAGTTCAAG GGCAGGGCCACAATAACTATAGACACGTCCGCCAGCACCGCCTACATGGAGCTCCGCAGCCTGAG ATCTGAGGATACTGCGGTCTATTACTGTGCAAGAAGAAGAATCGCCTATGGTTACGACGAGGGCC ATGCTATGGACTACTGGGGTCAAGGAACCCTGGTCACCGTCTCCTCAGGTGGTGGTGGTTCTGGC GGCGGCGGCTCCGGTGGTGGTGGTTCTGACATCGTGATGACACAGACTCCACTCTCCCTAGCTGT GACACCTGGAGAGCAGGCTTCTATCAGCTGCAAGTCCAGTCAGAGCCTTTTATATAGTCGTAATC AAAAGAACTACTTGGCCTGGTACCTGCAGAAGCCAGGGCAGTCTCCTCAACTGCTGATTTACTGG GCATCCACTAGGGAATCTGGGGTCCCTGATCGCTTCTCAGGCAGTGGATTTGGGACGGATTTCAC TCTCAAGATCAGCGGAGTGGAGGCTGAGGACGTGGGAGTTTATTACTGTCAGCAATATTTTAGCT ATCCGCTCACGTTCGGTGGTGGGACCAAGGTGGAGATCAAA |
| 791. | FA22E8 HL x I2C HL | artificial | aa | QVQLVQSGAELVKPGASVKVSCKASGYTFTEYTIHWVRQAPGQRLEWMGGINPNNGIPNYNQKFK GRATITIDTSASTAYMELRSLRSEDTAVYYCARRRIAYGYDEGHAMDYWGQGTLVTVSSGGGGSG GGGSGGGGSDIVMTQTPLSLAVTPGEQASISCKSSQSLLYSRNQKNYLAWYLQKPGQSPQLLIYW ASTRESGVPDRFSGSGFGTDFTLKISGVEAEDVGVYYCQQYFSYPLTFGGGTKVEIKSGGGGSEV QLVESGGGLVQPGGSLKLSCAASGFTFNKYAMNWVRQAPGKGLEWVARIRSKYNNYATYYADSVK DRFTISRDDSKNTAYLQMNNLKTEDTAVYYCVRHGNFGNSYISYWAYWGQGTLVTVSSGGGGSGG GGSGGGGSQTVVTQEPSLTVSPGGTVTLTCGSSTGAVTSGNYPNWVQQKPGQAPRGLIGGTKFLA PGTPARFSGSLLGGKAALTLSGVQPEDEAEYYCVLWYSNRWVFGGGTKLTVL |
| 792. | FA22E8 HL x I2C HL | artificial | nt | CAGGTGCAGCTGGTCCAGTCTGGAGCTGAGCTGGTGAAGCCTGGGGCTTCAGTAAAGGTGTCCTG CAAGGCTTCTGGATACACATTCACTGAATACACCATACACTGGGTGAGACAGGCCCCTGGACAGA GACTTGAGTGGATGGAGGTATTAATCCTAACAATGGTATTCCTAACTACAATCAGAAGTTCAAG GGCAGGGCCACAATAACTATAGACACGTCCGCCAGCACCGCCTACATGGAGCTCCGCAGCCTGAG ATCTGAGGATACTGCGGTCTATTACTGTGCAAGAAGAAGAATCGCCTATGGTTACGACGAGGGCC ATGCTATGGACTACTGGGGTCAAGGAACCCTGGTCACCGTCTCCTCAGGTGGTGGTGGTTCTGGC GGCGGCGGCTCCGGTGGTGGTGGTTCTGACATCGTGATGACACAGACTCCACTCTCCCTAGCTGT GACACCTGGAGAGCAGGCTTCTATCAGCTGCAAGTCCAGTCAGAGCCTTTTATATAGTCGTAATC AAAAGAACTACTTGGCCTGGTACCTGCAGAAGCCAGGGCAGTCTCCTCAACTGCTGATTTACTGG GCATCCACTAGGGAATCTGGGGTCCCTGATCGCTTCTCAGGCAGTGGATTTGGGACGGATTTCAC TCTCAAGATCAGCGGAGTGGAGGCTGAGGACGTGGGAGTTTATTACTGTCAGCAATATTTTAGCT ATCCGCTCACGTTCGGTGGTGGGACCAAGGTGGAGATCAAATCCGGAGGTGGTGGATCCGAGGTG CAGCTGGTCGAGTCTGGAGGAGGATTGGTGCAGCCTGGAGGGTCATTGAAACTCTCATGTGCAGC CTCTGGATTCACCTTCAATAAGTACGCCATGAACTGGGTCCGCCAGGCTCCAGGAAAGGGTTTG AATGGGTTGCTCGCATAAGAAGTAAATATAATAATTATGCAACATATTATGCCGATTCAGTGAAA GACAGGTTCACCATCTCCAGAGATGATTCAAAAAACACTGCCTATCTACAAATGAACAACTTGAA AACTGAGGACACTGCCGTGTACTACTGTGTGAGACATGGGAACTTCGGTAATAGCTACATATCCT ACTGGGCTTACTGGGGCCAAGGGACTCTGGTCACCGTCTCCTCAGGTGGTGGTGGTTCTGGCGGC GGCGGCTCCGGTGGTGGTGGTTCTCAGACTGTTGTGACTCAGGAACCTTCACTCACCGTATCACC TGGTGGAACAGTCACACTCACTTGTGGCTCCTCGACTGGGGCTGTTACATCTGGCAACTACCCAA ACTGGGTCCAACAAAAACCAGGTCAGGCACCCCGTGGTCTAATAGGTGGGACTAAGTTCCTCGCC CCCGGTACTCCTGCCAGATTCTCAGGCTCCCTGCTTGGAGGCAAGGCTGCCCTCACCCTCTCAGG GGTACAGCCAGAGGATGAGGCAGAATATTACTGTGTTCTATGGTACAGCAACCGCTGGGTGTTCG GTGGAGGAACCAAACTGACTGTCCTA |

| SEQ ID NO. | DESIGNATION | SOURCE | TYPE | SEQUENCE |
|---|---|---|---|---|
| 793. | FA20H3-H | artificial | aa | QVQLVQSGAEVKKPGASVKMSCKTSGYTFTEYTIHWVRQAPGQRLEWMGGINPNNGIPNYNQKFK GRATITRDTSSSTAYMELSSLRSEDTAVYYCARRRIAYGYDEGHAMDYWGQGTLVTVSS |
| 794. | FA20H3-HCDR1 | artificial | aa | EYTIH |
| 795. | FA20H3-HCDR2 | artificial | aa | GINPNNGIPNYNQKFKG |
| 796. | FA20H3-HCDR3 | artificial | aa | RRIAYGYDEGHAMDY |
| 797. | FA20H3-H | artificial | nt | CAGGTGCAGCTGGTCCAGTCTGGAGCTGAGGTGAAGAAGCCTGGGGCTTCAGTAAAGATGTCCTG CAAGACTTCTGGATACACATTCACTGAATACACCATACACTGGGTGAGACAGGCCCCTGGACAGA GACTTGAGTGGATGGGAGGTATTAATCCTAACAATGGTATTCCTAACTACAATCAGAAGTTCAAG GGCAGGGCCACAATAACTAGAGACACGTCCTCCAGCACCGCCTACATGGAGCTCAGCAGCCTGAG ATCTGAGGATACTGCGGTCTATTACTGTGCAAGAAGAAGAATCGCCTATGGTTACGACGAGGGCC ATGCTATGGACTACTGGGGTCAAGGAACCCTGGTCACCGTCTCCTCA |
| 798. | FA20H3-L | artificial | aa | DIVMTQTPFSLPVTPGEPASISCKSSQSLLYSRNQKNYLAWYQQKPGQSPQLLIYWASTRESGVP DRFSGSGSGTDFTLNISRVEAEDVGVYYCQQYFSYPLTFGGGTKVEIK |
| 799. | FA20H3-LCDR1 | artificial | aa | KSSQSLLYSRNQKNYLA |
| 800. | FA20H3-LCDR2 | artificial | aa | WASTRES |
| 801. | FA20H3-LCDR3 | artificial | aa | QQYFSYPLT |
| 802. | FA20H3-L | artificial | nt | GACATCGTGATGACACAGACTCCATTCTCCCTACCTGTGACACCTGGAGAGCCGGCTTCTATCAG CTGCAAGTCCAGTCAGAGCCTTTTATATAGTCGTAATCAAAAGAACTACTTGGCCTGGTACCAGC AGAAGCCAGGGCAGTCTCCTCAACTGCTGATTTACTGGGCATCCACTAGGGAATCTGGGGTCCCT GATCGCTTCTCAGGCAGTGGATCTGGGACAGACTTCACCCTCAATATCTCTCGTGTGGAGGCGGA GGATGTTGGAGTCTATTACTGTCAGCAATATTTTAGCTATCCGCTCACGTTCGGTGGTGGGACCA AGGTGGAGATCAAA |
| 803. | FA20H3-HL | artificial | aa | QVQLVQSGAEVKKPGASVKMSCKTSGYTFTEYTIHWVRQAPGQRLEWMGGINPNNGIPNYNQKFK GRATITRDTSSSTAYMELSSLRSEDTAVYYCARRRIAYGYDEGHAMDYWGQGTLVTVSSGGGGS GGGSGGGGSDIVMTQTPFSLPVTPGEPASISCKSSQSLLYSRNQKNYLAWYQQKPGQSPQLLIYW ASTRESGVPDRFSGSGSGTDFTLNISRVEAEDVGVYYCQQYFSYPLTFGGGTKVEIK |
| 804. | FA20H3-HL | artificial | nt | CAGGTGCAGCTGGTCCAGTCTGGAGCTGAGGTGAAGAAGCCTGGGGCTTCAGTAAAGATGTCCTG CAAGACTTCTGGATACACATTCACTGAATACACCATACACTGGGTGAGACAGGCCCCTGGACAGA GACTTGAGTGGATGGGAGGTATTAATCCTAACAATGGTATTCCTAACTACAATCAGAAGTTCAAG GGCAGGGCCACAATAACTAGAGACACGTCCTCCAGCACCGCCTACATGGAGCTCAGCAGCCTGAG ATCTGAGGATACTGCGGTCTATTACTGTGCAAGAAGAAGAATCGCCTATGGTTACGACGAGGGCC ATGCTATGGACTACTGGGGTCAAGGAACCCTGGTCACCGTCTCCTCAGGTGGTGGTGGTTCTGGC GGCGGCGGCTCCGGTGGTGGTGGTTCTGACATCGTGATGACACAGACTCCATTCTCCCTACCTGT GACACCTGGAGAGCCGGCTTCTATCAGCTGCAAGTCCAGTCAGAGCCTTTTATATAGTCGTAATC AAAAGAACTACTTGGCCTGGTACCAGCAGAAGCCAGGGCAGTCTCCTCAACTGCTGATTTACTGG GCATCCACTAGGGAATCTGGGGTCCCTGATCGCTTCTCAGGCAGTGGATCTGGGACAGACTTCAC CCTCAATATCTCTCGTGTGGAGGCGGAGGATGTTGGAGTCTATTACTGTCAGCAATATTTTAGCT ATCCGCTCACGTTCGGTGGTGGGACCAAGGTGGAGATCAAA |
| 805. | FA20H3 HL x I2C HL | artificial | aa | QVQLVQSGAEVKKPGASVKMSCKTSGYTFTEYTIHWVRQAPGQRLEWMGGINPNNGIPNYNQKFK GRATITRDTSSSTAYMELSSLRSEDTAVYYCARRRIAYGYDEGHAMDYWGQGTLVTVSSGGGGSG GGGSGGGGSDIVMTQTPFSLPVTPGEPASISCKSSQSLLYSRNQKNYLAWYQQKPGQSPQLLIYW ASTRESGVPDRFSGSGSGTDFTLNISRVEAEDVGVYYCQQYFSYPLTFGGGTKVEIKSGGGGSEV QLVESGGGLVQPGGSLKLSCAASGFTFNKYAMNWVRQAPGKGLEWVARIRSKYNNYATYYADSVK DRFTISRDDSKNTAYLQMNNLKTEDTAVYYCVRHGNFGNSYISYWAYWGQGTLVTVSSGGGGSGG GGSGGGGSQTVVTQEPSLTVSPGGTVTLTCGSSTGAVTSGNYPNWVQQKPGQAPRGLIGGTKFLA PGTPARFSGSLLGGKAALTLSGVQPEDEAEYYCVLWYSNRWVFGGGTKLTVL |
| 806. | FA20H3 HL x I2C HL | artificial | nt | CAGGTGCAGCTGGTCCAGTCTGGAGCTGAGGTGAAGAAGCCTGGGGCTTCAGTAAAGATGTCCTG CAAGACTTCTGGATACACATTCACTGAATACACCATACACTGGGTGAGACAGGCCCCTGGACAGA GACTTGAGTGGATGGGAGGTATTAATCCTAACAATGGTATTCCTAACTACAATCAGAAGTTCAAG GGCAGGGCCACAATAACTAGAGACACGTCCTCCAGCACCGCCTACATGGAGCTCAGCAGCCTGAG ATCTGAGGATACTGCGGTCTATTACTGTGCAAGAAGAAGAATCGCCTATGGTTACGACGAGGGCC ATGCTATGGACTACTGGGGTCAAGGAACCCTGGTCACCGTCTCCTCAGGTGGTGGTGGTTCTGGC GGCGGCGGCTCCGGTGGTGGTGGTTCTGACATCGTGATGACACAGACTCCATTCTCCCTACCTGT GACACCTGGAGAGCCGGCTTCTATCAGCTGCAAGTCCAGTCAGAGCCTTTTATATAGTCGTAATC AAAAGAACTACTTGGCCTGGTACCAGCAGAAGCCAGGGCAGTCTCCTCAACTGCTGATTTACTGG GCATCCACTAGGGAATCTGGGGTCCCTGATCGCTTCTCAGGCAGTGGATCTGGGACAGACTTCAC CCTCAATATCTCTCGTGTGGAGGCGGAGGATGTTGGAGTCTATTACTGTCAGCAATATTTTAGCT ATCCGCTCACGTTCGGTGGTGGGACCAAGGTGGAGATCAAATCCGGAGGTGGTGGATCCGAGGTG CAGCTGGTCGAGTCTGGAGGAGGATTGGTGCAGCCTGGAGGGTCATTGAAACTCTCATGTGCAGC CTCTGGATTCACCTTCAATAAGTACGCCATGAACTGGGTCCGCCAGGCTCCAGGAAAGGGTTTGG AATGGGTTGCTCGCATAAGAAGTAAATATAATAATTATGCAACATATTATGCCGATTCAGTGAAA GACAGGTTCACCATCTCCAGAGATGATTCAAAAAACACTGCCTATCTACAAATGAACAACTTGAA |

| SEQ ID NO. | DESIGNATION | SOURCE | TYPE | SEQUENCE |
|---|---|---|---|---|
| | | | | AACTGAGGACACTGCCGTGTACTACTGTGTGAGACATGGGAACTTCGGTAATAGCTACATATCCT ACTGGGCTTACTGGGGCCAAGGGACTCTGGTCACCGTCTCCTCAGGTGGTGGTGGTTCTGGCGGC GGCGGCTCCGGTGGTGGTGGTTCTCAGACTGTTGTGACTCAGGAACCTTCACTCACCGTATCACC TGGTGGAACAGTCACACTCACTTGTGGCCTCTCGACTGGGGCTGTTACATCTGGCAACTACCCAA ACTGGGTCCAACAAAAACCAGGTCAGGCACCCCGTGGTCTAATAGGTGGGACTAAGTTCCTCGCC CCCGGTACTCCTGCCAGATTCTCAGGCTCCCTGCTTGGAGGCAAGGCTGCCCTCACCCTCTCAGG GGTACAGCCAGAGGATGAGGCAGAATATTACTGTGTTCTATGGTACAGCAACCGCTGGGTGTTCG GTGGAGGAACCAAACTGACTGTCCTA |
| 807. | FA19D12-H | artificial | aa | QVQLVQSGAEVKKPGASVKVSCKASGYTFTEYTIHWVRQAHGQSLEWMGGINPNNGIPNYNQKFK GRVTITVDTSASTAYMELRSLRSEDTAVYYCARRRIAYGYDEGHAMDYWGQGTLVTVSS |
| 808. | FA19D12-HCDR1 | artificial | aa | EYTIH |
| 809. | FA19D12-HCDR2 | artificial | aa | GINPNNGIPNYNQKFKG |
| 810. | FA19D12-HCDR3 | artificial | aa | RRIAYGYDEGHAMDY |
| 811. | FA19D12-H | artificial | nt | CAGGTGCAGCTGGTCCAGTCTGGAGCTGAGGTGAAGAAGCCTGGGGCTTCAGTAAAGGTGTCCTG CAAGGCTTCTGGATACACATTCACTGAATACACCATACACTGGGTGAGACAGGCCCATGGACAGA GCCTTGAGTGGATGGGAGGTATTAATCCTAACAATGGTATTCCTAACTACAATCAGAAGTTCAAG GGCAGGGTCACAATAACTGTAGACACGTCCGCCAGCACCGCCTACATGGAGCTCCGCAGCCTGAG ATCTGAGGATACTGCGGTCTATTACTGTGCAAGAAGAAATCGCCTATGGTTACGACGAGGGCC ATGCTATGGACTACTGGGGTCAAGGAACCCTGGTCACCGTCTCCTCAGGTGGTGGTGGTTCTGGC GGCGGCGGCTCCGGTGGTGGTGGTTCT |
| 812. | FA19D12-L | artificial | aa | DIVMTQTPFSLPVTPGEPASISCKSSQSLLYSRNQKNYLAWYQQKPGQSPKLLIYWASTRESGVP DRFSGSGSGTDFTLKISRVEAEDVGVYYCQQYFSYPLTFGGGTKVEIK |
| 813. | FA19D12-LCDR1 | artificial | aa | KSSQSLLYSRNQKNYLA |
| 814. | FA19D12-LCDR2 | artificial | aa | WASTRES |
| 815. | FA19D12-LCDR3 | artificial | aa | QQYFSYPLT |
| 816. | FA19D12-L | artificial | nt | GACATCGTGATGACACAGACTCCATTCTCCCTACCTGTGACACCTGGAGAGCCGGCTTCTATCAG CTGCAAGTCCAGTCAGAGCCTTTTATATAGTCGTAATCAAAAGAACTACTTGGCCTGGTACCAGC AGAAGCCAGGGCAGTCTCCTAAACTGCTGATTTACTGGGCATCCACTAGGGAATCTGGGGTCCCT GATCGCTTCTCAGGCAGTGGATCTGGGACGGATTTCACTCTCAAAATCTCCAGAGTGGAGGCTGA GGACGTGGGAGTTTATTACTGTCAGCAATATTTTAGCTATCCGCTCACGTTCGGTGGTGGGACCA AGGTGGAGATCAAA |
| 817. | FA19D12-HL | artificial | aa | QVQLVQSGAEVKKPGASVKVSCKASGYTFTEYTIHWVRQAHGQSLEWMGGINPNNGIPNYNQKFK GRVTITVDTSASTAYMELRSLRSEDTAVYYCARRRIAYGYDEGHAMDYWGQGTLVTVSSGGGGSG GGGSGGGGSDIVMTQTPFSLPVTPGEPASISCKSSQSLLYSRNQKNYLAWYQQKPGQSPKLLIYW ASTRESGVPDRFSGSGSGTDFTLKISRVEAEDVGVYYCQQYFSYPLTFGGGTKVEIK |
| 818. | FA19D12-HL | artificial | nt | CAGGTGCAGCTGGTCCAGTCTGGAGCTGAGGTGAAGAAGCCTGGGGCTTCAGTAAAGGTGTCCTG CAAGGCTTCTGGATACACATTCACTGAATACACCATACACTGGGTGAGACAGGCCCATGGACAGA GCCTTGAGTGGATGGGAGGTATTAATCCTAACAATGGTATTCCTAACTACAATCAGAAGTTCAAG GGCAGGGTCACAATAACTGTAGACACGTCCGCCAGCACCGCCTACATGGAGCTCCGCAGCCTGAG ATCTGAGGATACTGCGGTCTATTACTGTGCAAGAAGAAATCGCCTATGGTTACGACGAGGGCC ATGCTATGGACTACTGGGGTCAAGGAACCCTGGTCACCGTCTCCTCAGGTGGTGGTGGTTCTGGC GGCGGCGGCTCCGGTGGTGGTGGTTCTGACATCGTGATGACACAGACTCCATTCTCCCTACCTGT GACACCTGGAGAGCCGGCTTCTATCAGCTGCAAGTCCAGTCAGAGCCTTTTATATAGTCGTAATC AAAAGAACTACTTGGCCTGGTACCAGCAGAAGCCAGGGCAGTCTCCTAAACTGCTGATTTACTGG GCATCCACTAGGGAATCTGGGGTCCCTGATCGCTTCTCAGGCAGTGGATCTGGGACGGATTTCAC TCTCAAAATCTCCAGAGTGGAGGCTGAGGACGTGGGAGTTTATTACTGTCAGCAATATTTTAGCT ATCCGCTCACGTTCGGTGGTGGGACCAAGGTGGAGATCAAA |
| 819. | FA19D12HL x I2C HL | artificial | aa | QVQLVQSGAEVKKPGASVKVSCKASGYTFTEYTIHWVRQAHGQSLEWMGGINPNNGIPNYNQKFK GRVTITVDTSASTAYMELRSLRSEDTAVYYCARRRIAYGYDEGHAMDYWGQGTLVTVSSGGGGSG GGGSGGGGSDIVMTQTPFSLPVTPGEPASISCKSSQSLLYSRNQKNYLAWYQQKPGQSPKLLIYW ASTRESGVPDRFSGSGSGTDFTLKISRVEAEDVGVYYCQQYFSYPLTFGGGTKVEIKSGGGGSGG QLVESGGGLVQPGGSLKLSCAASGFTFNKYAMNWVRQAPGKGLEWVARIRSKYNNYATYYADSVK DRFTISRDDSKNTAYLQMNNLKTEDTAVYYCVRHGNFGNSYISYWAYWGQGTLVTVSSGGGGSGG GGSGGGGSQTVVTQEPSLTVSPGGTVTLTCGSSTGAVTSGNYPNWVQQKPGQAPRGLIGGTKFLA PGTPARFSGSLLGGKAALTLSGVQPEDEAEYYCVLWYSNRWVFGGGTKLTVL |
| 820. | FA19D12HL x I2C HL | artificial | nt | CAGGTGCAGCTGGTCCAGTCTGGAGCTGAGGTGAAGAAGCCTGGGGCTTCAGTAAAGGTGTCCTG CAAGGCTTCTGGATACACATTCACTGAATACACCATACACTGGGTGAGACAGGCCCATGGACAGA GCCTTGAGTGGATGGGAGGTATTAATCCTAACAATGGTATTCCTAACTACAATCAGAAGTTCAAG GGCAGGGTCACAATAACTGTAGACACGTCCGCCAGCACCGCCTACATGGAGCTCCGCAGCCTGAG ATCTGAGGATACTGCGGTCTATTACTGTGCAAGAAGAAATCGCCTATGGTTACGACGAGGGCC ATGCTATGGACTACTGGGGTCAAGGAACCCTGGTCACCGTCTCCTCAGGTGGTGGTGGTTCTGGC |

| SEQ ID NO. | DESIGNATION | SOURCE | TYPE | SEQUENCE |
|---|---|---|---|---|
| | | | | GGCGGCGGCTCCGGTGGTGGTGGTTCTGACATCGTGATGACACAGACTCCATTCTCCCTACCTGT<br>GACACCTGGAGAGCCGGCTTCTATCAGCTGCAAGTCCAGTCAGAGCCTTTTATATAGTCGTAATC<br>AAAAGAACTACTTGGCCTGGTACCAGCAGAAGCCAGGGCAGTCTCCTAAACTGCTGATTTACTGG<br>GCATCCACTAGGGAATCTGGGGTCCCTGATCGCTTCTCAGGCAGTGGATCTGGGACGGATTTCAC<br>TCTCAAAATCTCCAGAGTGGAGGCTGAGGACGTGGGAGTTTATTACTGTCAGCAATATTTTAGCT<br>ATCCGCTCACGTTCGGTGGTGGGACCAAGGTGGAGATCAAATCCGGAGGTGGTGGATCCGAGGTG<br>CAGCTGGTCGAGTCTGGAGGAGGATTGGTGCAGCCTGGAGGGTCATTGAAACTCTCATGTGCAGC<br>CTCTGGATTCACCTTCAATAAGTACGCCATGAACTGGGTCCGCCAGGCTCCAGGAAAGGGTTTGG<br>AATGGGTTGCTCGCATAAGAAAGTAAATATAATTATGCAACATATTATGCCGATTCAGTGAAA<br>GACAGGTTCACCATCTCCAGAGATGATTCAAAAAACACTGCCTATCTACAAATGAACAACTTGAA<br>AACTGAGGACACTGCCGTGTACTACTGTGTGAGACATGGGAACTTCGGTAATAGCTACATATCCT<br>ACTGGGCTTACTGGGGCCAAGGGACTCTGGTCACCGTCTCCTCAGGTGGTGGTGGTTCTGGCGGC<br>GGCGGCTCCGGTGGTGGTGGTTCTCAGACTGTTGTGACTCAGGAACCTTCACTCACCGTATCACC<br>TGGTGAACAGTCACACTCACTTGTGGCCTCTCGACTGGGGCTGTTACATCTGGCAACTACCCAA<br>ACTGGGTCCAACAAAAACCAGGTCAGGCACCCCGTGGTCTAATAGGTGGGACTAAGTTCCTCGCC<br>CCCGGTACTCCTGCCAGATTCTCAGGCTCCCTGCTTGGAGGCAAGGCTGCCCTCACCCTCTCAGG<br>GGTACAGCCAGAGGATGAGGCAGAATATTACTGTGTTCTATGGTACAGCAACCGCTGGGTGTTCG<br>GTGGAGGAACCAAACTGACTGTCCTA |
| 821. | FA19D9-H | artificial | aa | QVQLVQSGAEVKKPGASVKVSCKTSGYTFTEYTIHWVRQAPGQRLEWMGGINPNNGIPNYNQKFK<br>GRATLTIDTSASTAYMELSSLTSEDTAVYYCARRRIAYGYDEGHAMDYWGQGTLVTVSS |
| 822. | FA19D9-HCDR1 | artificial | aa | EYTIH |
| 823. | FA19D9-HCDR2 | artificial | aa | GINPNNGIPNYNQKFKG |
| 824. | FA19D9-HCDR3 | artificial | aa | RRIAYGYDEGHAMDY |
| 825. | FA19D9-H | artificial | nt | CAGGTGCAGCTGGTCCAGTCTGGAGCTGAGGTGAAGAAGCCTGGGGCTTCAGTAAAGGTGTCCTG<br>CAAGACTTCTGGATACACATTCACTGAATACACCATACACTGGGTGAGACAGGCCCCTGGACAGA<br>GACTTGAGTGGATGGGAGGTATTAATCCTAACAATGGTATTCCTAACTACAATCAGAAGTTCAAG<br>GGCAGGGCCACATTAACTATAGACACGTCCGCCAGCACCGCCTACATGGAGCTCAGCAGCCTGAC<br>ATCTGAGGATACTGCCGTCTATTACTGTGCAAGAAGAATCGCCTATGGTTACGACGAGGGCC<br>ATGCTATGGACTACTGGGGTCAAGGAACCCTGGTCACCGTCTCCTCA |
| 826. | FA19D9-L | artificial | aa | DIVMTQTPLSLPVTPGEPASMSCKSSQSLLYSRNQKNYLAWFLQKPGQSPKLLIYWASTRESGVP<br>DRFSGSGSGTDFTLKISRVEAEDVGVYYCQQYFSYPLTFGGGTKVEIK |
| 827. | FA19D9-LCDR1 | artificial | aa | KSSQSLLYSRNQKNYLA |
| 828. | FA19D9-LCDR2 | artificial | aa | WASTRES |
| 829. | FA19D9-LCDR3 | artificial | aa | QQYFSYPLT |
| 830. | FA19D9-L | artificial | nt | GACATCGTGATGACACAGACTCCACTCTCCCTACCTGTGACACCTGGAGAGCCGGCTTCTATGAG<br>CTGCAAGTCCAGTCAGAGCCTTTTATATAGTCGTAATCAAAAGAACTACTTGGCCTGGTTCCTGC<br>AGAAGCCAGGGCAGTCTCCTAAACTGCTGATTTACTGGGCATCCACTAGGGAATCTGGGGTCCCT<br>GATCGCTTCTCAGGCAGTGGATCTGGGACGGATTTCACTCTCAAGATCAGCAGAGTGGAGGCTGA<br>GGACGTGGGAGTTTATTACTGTCAGCAATATTTTAGCTATCCGCTCACGTTCGGTGGTGGGACCA<br>AGGTGGAGATCAAA |
| 831. | FA19D9-HL | artificial | aa | QVQLVQSGAEVKKPGASVKVSCKTSGYTFTEYTIHWVRQAPGQRLEWMGGINPNNGIPNYNQKFK<br>GRATLTIDTSASTAYMELSSLTSEDTAVYYCARRRIAYGYDEGHAMDYWGQGTLVTVSSGGGGSG<br>GGGSGGGGSDIVMTQTPLSLPVTPGEPASMSCKSSQSLLYSRNQKNYLAWFLQKPGQSPKLLIYW<br>ASTRESGVPDRFSGSGSGTDFTLKISRVEAEDVGVYYCQQYFSYPLTFGGGTKVEIK |
| 832. | FA19D9-HL | artificial | nt | CAGGTGCAGCTGGTCCAGTCTGGAGCTGAGGTGAAGAAGCCTGGGGCTTCAGTAAAGGTGTCCTG<br>CAAGACTTCTGGATACACATTCACTGAATACACCATACACTGGGTGAGACAGGCCCCTGGACAGA<br>GACTTGAGTGGATGGGAGGTATTAATCCTAACAATGGTATTCCTAACTACAATCAGAAGTTCAAG<br>GGCAGGGCCACATTAACTATAGACACGTCCGCCAGCACCGCCTACATGGAGCTCAGCAGCCTGAC<br>ATCTGAGGATACTGCCGTCTATTACTGTGCAAGAAGAATCGCCTATGGTTACGACGAGGGCC<br>ATGCTATGGACTACTGGGGTCAAGGAACCCTGGTCACCGTCTCCTCAGGTGGTGGTGGTTCTGGC<br>GGCGGCGGCTCCGGTGGTGGTGGTTCTGACATCGTGATGACACAGACTCCACTCTCCCTACCTGT<br>GACACCTGGAGAGCCGGCTTCTATGAGCTGCAAGTCCAGTCAGAGCCTTTTATATAGTCGTAATC<br>AAAAGAACTACTTGGCCTGGTTCCTGCAGAAGCCAGGGCAGTCTCCTAAACTGCTGATTTACTGG<br>GCATCCACTAGGGAATCTGGGGTCCCTGATCGCTTCTCAGGCAGTGGATCTGGGACGGATTTCAC<br>TCTCAAGATCAGCAGAGTGGAGGCTGAGGACGTGGGAGTTTATTACTGTCAGCAATATTTTAGCT<br>ATCCGCTCACGTTCGGTGGTGGGACCAAGGTGGAGATCAAA |
| 833. | FA19D9HL x I2C HL | artificial | aa | QVQLVQSGAEVKKPGASVKVSCKTSGYTFTEYTIHWVRQAPGQRLEWMGGINPNNGIPNYNQKFK<br>GRATLTIDTSASTAYMELSSLTSEDTAVYYCARRRIAYGYDEGHAMDYWGQGTLVTVSSGGGGSG<br>GGGSGGGGSDIVMTQTPLSLPVTPGEPASMSCKSSQSLLYSRNQKNYLAWFLQKPGQSPKLLIYW<br>ASTRESGVPDRFSGSGSGTDFTLKISRVEAEDVGVYYCQQYFSYPLTFGGGTKVEIKSGGGGSEV<br>QLVESGGGLVQPGGSLKLSCAASGFTFNKYAMNWVRQAPGKGLEWVARIRSKYNNYATYYADSVK<br>DRFTISRDDSKNTAYLQMNNLKTEDTAVYYCVRHGNFGNSYISYWAYWGQGTLVTVSSGGGGSGG |

| SEQ ID NO. | DESIGNATION | SOURCE | TYPE | SEQUENCE |
|---|---|---|---|---|
| | | | | GGSGGGGSQTVVTQEPSLTVSPGGTVTLTCGSSTGAVTSGNYPNWVQQKPGQAPRGLIGGTKFLA PGTPARFSGSLLGGKAALTLSGVQPEDEAEYYCVLWYSNRWVFGGGTKLTVL |
| 834. | FA19D9HL x I2C HL | artificial | nt | CAGGTGCAGCTGGTCCAGTCTGGAGCTGAGGTGAAGAAGCCTGGGGCTTCAGTAAAGGTGTCCTG CAAGACTTCTGGATACACATTCACTGAATACACCATACACTGGGTGAGACAGGCCCCTGGACAGA GACTTGAGTGGATGGAGGTATTAATCCTAACAATGGTATTCCTAACTACAATCAGAAGTTCAAG GGCAGGGCCACATTAACTATAGAGACGTCCGCCAGCACCGCCTACATGGAGCTCAGCAGCCTGAC ATCTGAGGATACTGCCGTCTATTACTGTGCAAGAAGAAGAATCGCCTATGGTTACGACGAGGGCC ATGCTATGGACTACTGGGGTCAAGGAACCCTGGTCACCGTCTCCTCAGGTGGTGGTGGTTCTGGC GGCGGCGGCTCCGGTGGTGGTGGTTCTGACATCGTGATGACACAGACTCCACTCTCCCTACCTGT GACACCTGGAGAGCCGGCTTCTATGAGCTGCAAGTCCAGTCAGAGCCTTTTATATAGTCGTAATC AAAAGAACTACTTGGCCTGGTTCCTGCAGAAGCCAGGGCAGTCTCCTAAACTGCTGATTTACTGG GCATCCACTAGGGAATCTGGGGTCCCTGATCGCTTCTCAGGCAGTGGATCTGGGACGGATTTCAC TCTCAAGATCAGCAGAGTGGAGGCTGAGGACGTGGGAGTTTATTACTGTCAGCAATATTTTAGCT ATCCGCTCACGTTCGGTGGTGGGACCAAGGTGGAGATCAAATCCGGAGGTGGTGGATCCGAGGTG CAGCTGGTCGAGTCTGGAGGAGGATTGGTGCAGCCTGGAGGGTCATTGAAACTCTCATGTGCAGC CTCTGGATTCACCTTCAATAAGTACGCCATGAACTGGGTCCGCCAGGCTCCAGGAAAGGGTTTGG AATGGGTTGCTCGCATAAGAAGTAAATATAATTATGCAACATATTATGCCGATTCAGTGAAA GACAGGTTCACCATCTCCAGAGATGATTCAAAAAACACTGCCTATCTACAAATGAACAACTTGAA AACTGAGGACACTGCCGTGTACTACTGTGTGAGACATGGGAACTTCGGTAATAGCTACATATCCT ACTGGGCTTACTGGGGCCAAGGGACTCTGGTCACCGTCTCCTCAGGTGGTGGTGGTTCTGGCGGC GGCGGCTCCGGTGGTGGTGGTTCTCAGACTGTTGTGACTCAGGAACCTTCACTCACCGTATCACC TGGTGAACAGTCACACTCACTTGTGGCTCCTCGACTGGGGCTGTTACATCTGGCAACTACCCAA ACTGGGTCAACAAAACCAGGTCAGGCACCCCGTGGTCTAATAGGTGGGACTAAGTTCCTCGCC CCCGGTACTCCTGCCAGATTCTCAGGCTCCCTGCTTGGAGGCAAGGCTGCCCTCACCCTCTCAGG GGTACAGCCAGAGGATGAGGCAGAATATTACTGTGTTCTATGGTACAGCAACCGCTGGGTGTTCG GTGGAGGAACCAAACTGACTGTCCTA |
| 835. | IGF1R12-H | artificial | aa | EVQLLESGGGLVQPGSLRLSCAASGFTFSNYPMYWVRQAPGKGLEWVSRISSSGGRTVYADSVK GRFTISRDNSKNTLYLQMNSLRAEDTAVYYCARDRWSRSAAEYGLGGYWGQGTLVTVSS |
| 836. | IGF1R12-HCDR1 | artificial | aa | NYPMY |
| 837. | IGF1R12-HCDR2 | artificial | aa | RISSSGGRTVYADSVKG |
| 838. | IGF1R12-HCDR3 | artificial | aa | DRWSRSAAEYGLGGY |
| 839. | IGF1R12-H | artificial | nt | GAAGTCCAGCTCCTTGAAAGCGGTGGCGGATTGGTCCAGCCTGGAGGCTCTTTGAGACTCTCCTG TGCCGCATCAGGCTTCACCTTTTCCAACTATCCTATGTACTGGGTTCGCCAGGCTCCTGGAAAAG GCTTGGAATGGGTGTCACGGATTAGCTCTAGCGGGGAAGGACTGTCTATGCCGATTCCGTGAAA GGGAGATTCACCATCTCTCGGGACAATAGCAAGAACACCCTGTATCTCCAGATGAACTCTCTTCG TGCCGAAGACACTGCCGTGTATTACTGCGCACGAGACCGATGGAGCCGATCAGCAGCTGAATACG GCTTGGGAGGCTACTGGGGTCAGGGAACTCTTGTGACTGTCTCTAGC |
| 840. | IGF1R12-L | artificial | aa | DIQMTQSPDSLAVSLGERATINCKSSQSVLYSSNNKNYLAWYQQKPGQPPKLLIYLASTRESGVP DRFSGSGSGTDFTLTISSLQAEDVAVYYCQQYYSTWTFGQGTKVEIK |
| 841. | IGF1R12-LCDR1 | artificial | aa | KSSQSVLYSSNNKNYLA |
| 842. | IGF1R12-LCDR2 | artificial | aa | LASTRES |
| 843. | IGF1R12-LCDR3 | artificial | aa | QQYYSTWT |
| 844. | IGF1R12-L | artificial | nt | GATATCCAGATGACTCAGAGCCCTGATTCACTGGCAGTGTCTCTCGGAGAACGTGCCACAATCAA CTGCAAGAGTAGCCAGTCCGTCCTTTACTCCTCCAACAACAAAAACTACCTCGCATGGTACCAGC AGAAACCTGGGCAGCCACCCAAACTTCTCATCTATCTTGCTTCCACACGTGAGAGTGGCGTGCCT GACCGTTTTAGCGGATCCGGTAGCGGAACAGATTTCACTCTCACAATCTCAAGCCTGCAGGCTGA AGATGTCGCAGTCTACTATTGCCAGCAGTATTACTCAACCTGGACATTCGGACAGGGGACAAAAG TGGAGATCAAA |
| 845. | IGF1R12-HL | artificial | aa | EVQLLESGGGLVQPGSLRLSCAASGFTFSNYPMYWVRQAPGKGLEWVSRISSSGGRTVYADSVK GRFTISRDNSKNTLYLQMNSLRAEDTAVYYCARDRWSRSAAEYGLGGYWGQGTLVTVSSGGGGSG GGGSGGGGSDIQMTQSPDSLAVSLGERATINCKSSQSVLYSSNNKNYLAWYQQKPGQPPKLLIYL ASTRESGVPDRFSGSGSGTDFTLTISSLQAEDVAVYYCQQYYSTWTFGQGTKVEIK |
| 846. | IGF1R12-HL | artificial | nt | GAAGTCCAGCTCCTTGAAAGCGGTGGCGGATTGGTCCAGCCTGGAGGCTCTTTGAGACTCTCCTG TGCCGCATCAGGCTTCACCTTTTCCAACTATCCTATGTACTGGGTTCGCCAGGCTCCTGGAAAAG GCTTGGAATGGGTGTCACGGATTAGCTCTAGCGGGGAAGGACTGTCTATGCCGATTCCGTGAAA GGGAGATTCACCATCTCTCGGGACAATAGCAAGAACACCCTGTATCTCCAGATGAACTCTCTTCG TGCCGAAGACACTGCCGTGTATTACTGCGCACGAGACCGATGGAGCCGATCAGCAGCTGAATACG GCTTGGGAGGCTACTGGGGTCAGGGAACTCTTGTGACTGTCTCTAGCGGAGGCGGTGGAAGCGGG GGAGGCGGATCTGGTGGAGGCGGAAGCGATATCCAGATGACTCAGAGCCCTGATTCACTGGCAGT GTCTCTCGGAGAACGTGCCACAATCAACTGCAAGAGTAGCCAGTCCGTCCTTTACTCCTCCAACA ACAAAAACTACCTCGCATGGTACCAGCAGAAACCTGGGCAGCCACCCAAACTTCTCATCTATCTT GCTTCCACACGTGAGAGTGGCGTGCCTGACCGTTTTAGCGGATCCGGTAGCGGAACAGATTTCAC |

| SEQ ID NO. | DESIGNATION | SOURCE | TYPE | SEQUENCE |
|---|---|---|---|---|
| | | | | TCTCACAATCTCAAGCCTGCAGGCTGAAGATGTCGCAGTCTACTATTGCCAGCAGTATTACTCAA<br>CCTGGACATTCGGACAGGGGACAAAAGTGGAGATCAAA |
| 847. | IGF1R12HL x I2C HL | artificial | aa | EVQLLESGGGLVQPGGSLRLSCAASGFTFSNYPMYWVRQAPGKGLEWVSRISSSGGRTVYADSVK<br>GRFTISRDNSKNTLYLQMNSLRAEDTAVYYCARDRWSRSAAEYGLGGYWGQGTLVTVSSGGGGSG<br>GGGSGGGGSDIQMTQSPDSLAVSLGERATINCKSSQSVLYSSNNKNYLAWYQQKPGQPPKLLIYL<br>ASTRESGVPDRFSGSGSGTDFTLTISSLQAEDVAVYYCQQYYSTWTFGQGTKVEIKSGGGGSEVQ<br>LVESGGGLVQPGGSLKLSCAASGFTFNKYAMNWVRQAPGKGLEWVARIRSKYNNYATYYADSVKD<br>RFTISRDDSKNTAYLQMNNLKTEDTAVYYCVRHGNFGNSYISYWAYWGQGTLVTVSSGGGGSGGG<br>GSGGGGSQTVVTQEPSLTVSPGGTVTLTCGSSTGAVTSGNYPNWVQQKPGQAPRGLIGGTKFLAP<br>GTPARFSGSLLGGKAALTLSGVQPEDEAEYYCVLWYSNRWVFGGGTKLTVL |
| 848. | IGF1R12HL x I2C HL | artificial | nt | GAAGTCCAGCTCCTTGAAAGCGGTGGCGGATTGGTCCAGCCTGGAGGCTCTTTGAGACTCTCCTG<br>TGCCGCATCAGGCTTCACCTTTTCCAACTATCCTATGTACTGGGTTCGCCAGGCTCCTGGAAAAG<br>GCTTGGAATGGGTGTCACGGATTAGCTCTAGCGGGGAAGGACTGTCTATGCCGATTCCGTGAAA<br>GGGAGATTCACCATCTCTCGGGACAATAGCAAGAACACCCTGTATCTCCAGATGAACTCTCTTCG<br>TGCCGAAGACACTGCCGTGTATTACTGCGCACGAGACCGATGGAGCCGATCAGCAGCTGAATACG<br>GCTTGGGAGGCTACTGGGGTCAGGGGACTCTTGTGACTGTCTCTAGCGGAGGCGGTGGAAGCGGG<br>GGAGGCGGATCTGGTGGAGGCGGAAGCGATATCCAGATGACTCAGAGCCCTGATTCACTGGCAGT<br>GTCTCTCGGAGAACGTGCCACAATCAACTGCAAGAGTAGCCAGTCCGTCCTTTACTCCTCCAACA<br>ACAAAAACTACCTCGCATGGTACCAGCAGAAACCTGGGCAGCCACCCAAACTTCTCATCTATCTT<br>GCTTCCACACGTGAGAGTGGCGTGCCTGACCGTTTTAGCGGATCCGGTAGCGGAACAGATTTCAC<br>TCTCACAATCTCAAGCCTGCAGGCTGAAGATGTCGCAGTCTACTATTGCCAGCAGTATTACTCAA<br>CCTGGACATTCGGACAGGGGACAAAAGTGGAGATCAAATCCGGAGGTGGTGGATCCGAGGTGCAG<br>CTGGTCGAGTCTGGAGGAGGATTGGTGCAGCCTGGAGGGTCATTGAAACTCTCATGTGCAGCCTC<br>TGGATTCACCTTCAATAAGTACGCCATGAACTGGGTCCGCCAGGCTCCAGGGAAAGGGTTTGGAAT<br>GGGTTGCTCGCATAAGAAGTAAATATAATAATTATGCAACATATTATGCCGATTCAGTGAAAGAC<br>AGGTTCACCATCTCCAGAGATGATTCAAAAAACACTGCCTATCTACAAATGAACAACTTGAAGAC<br>TGAGGACACTGCCGTGTACTACTGTGTGAGACATGGGAACTTCGGTAATAGCTACATATCCTACT<br>GGGCTTACTGGGGCCAAGGGACTCTGGTCACCGTCTCCTCAGGTGGTGGTGGTTCTGGCGGCGGC<br>GGCTCCGGTGGTGGTGGTTCTCAGACTGTTGTGACTCAGGAACCTTCACTCACCGTATCACCTGG<br>TGGAACAGTCACACTCACTTGTGGCTCCTCGACTGGGGCTGTTACATCTGGCAACTACCCAAACT<br>GGGTCCAACAAAAACCAGGTCAGGCACCCCGTGGTCTAATAGGTGGGACTAAGTTCCTCGCCCCC<br>GGTACTCCTGCCAGATTCTCAGGCTCCCTGCTTGGAGGCAAGGCTGCCCTCACCCTCTCAGGGGT<br>ACAGCCAGAGGATGAGGCAGAATATTACTGTGTTCTATGGTACAGCAACCGCTGGGTGTTCGGTG<br>GAGGAACCAAACTGACTGTCCTA |
| 849. | IGF1R24-H | artificial | aa | EVQLVESGGELVQPGGSLRLSCAASGFTFSSYAMSWVRQAPGKGLEWVSRISPSGGSTYYADSVK<br>GRFTISADTSKNTAYLQMNSLRAEDTAVYYCAREEYYYWGAMDVWGQGTLVTVSS |
| 850. | IGF1R24-HCDR1 | artificial | aa | SYAMS |
| 851. | IGF1R24-HCDR2 | artificial | aa | RISPSGGSTYYADSVKG |
| 852. | IGF1R24-HCDR3 | artificial | aa | EEYYYWGAMDV |
| 853. | IGF1R24-H | artificial | nt | GAAGTTCAGCTGGTGGAATCCGGGGGAGAGCTTGTTCAGCCTGGCGGATCACTTAGGCTGTCCTG<br>TGCTGCAAGCGGCTTCACCTTCTCTAGCTATGCCATGTCATGGGTGCGACAGGCCCCTGGAAAAG<br>GACTGGAGTGGGTCTCACGTATCTCTCCAAGTGGCGGATCCACATACTACGCCGATAGCGTGAAA<br>GGGAGGTTTACCATTTCCGCTGACACCTCCAAGAACACCGCCTACCTGCAGATGAACTCACTGAG<br>AGCCGAAGACACTGCCGTGTACTATTGCGCACGGGAGGAGTACTACTATTGGGGAGCTATGGACG<br>TGTGGGGACAGGGAACATTGGTGACTGTGTCTTCC |
| 854. | IGF1R24-L | artificial | aa | DIQMTQSPSSLSASVGDRVTITCRASQSISSYLAWYQQKPGKAPKLLIYGASSRASGVPSRFSGS<br>GSGTDFTLTISSLQPEDFATYYCQQYYSSPLTFGQGTKVEIK |
| 855. | IGF1R24-LCDR1 | artificial | aa | RASQSISSYLA |
| 856. | IGF1R24-LCDR2 | artificial | aa | GASSRAS |
| 857. | IGF1R24-LCDR3 | artificial | aa | QQYYSSPLT |
| 858. | IGF1R24-L | artificial | nt | GATATCCAGATGACACAGAGCCCAAGCTCACTGAGCGCTAGCGTCGGAGATAGAGTCACCATCAC<br>CTGTAGGGCAAGCCAGAGCATCTCTAGCTACCTGGCATGGTACCAGCAGAAACCTGGCAAGGCTC<br>CCAAGCTCCTGATCTACGGCGCTTCATCTAGAGCTAGCGGCGTTCCCTCACGATTTAGCGGAAGC<br>GGAAGCGGAACTGACTTCACCCTGACCATTTCAAGCCTCCAGCCTGAGGATTTCGCCACCTACTA<br>CTGCCAGCAGTACTACTCTAGCCCACTCACATTTGGGCAGGGGACAAAGGTGGAGATCAAG |
| 859. | IGF1R24-HL | artificial | aa | EVQLVESGGELVQPGGSLRLSCAASGFTFSSYAMSWVRQAPGKGLEWVSRISPSGGSTYYADSVK<br>GRFTISADTSKNTAYLQMNSLRAEDTAVYYCAREEYYYWGAMDVWGQGTLVTVSSGGGGSGGGGS<br>GGGGSDIQMTQSPSSLSASVGDRVTITCRASQSISSYLAWYQQKPGKAPKLLIYGASSRASGVPS<br>RFSGSGSGTDFTLTISSLQPEDFATYYCQQYYSSPLTFGQGTKVEIK |
| 860. | IGF1R24-HL | artificial | nt | GAAGTTCAGCTGGTGGAATCCGGGGGAGAGCTTGTTCAGCCTGGCGGATCACTTAGGCTGTCCTG<br>TGCTGCAAGCGGCTTCACCTTCTCTAGCTATGCCATGTCATGGGTGCGACAGGCCCCTGGAAAAG |

| SEQ ID NO. | DESIGNATION | SOURCE | TYPE | SEQUENCE |
|---|---|---|---|---|
| | | | | GACTGGAGTGGGTCTCACGTATCTCTCCAAGTGGCGGATCCACATACTACGCCGATAGCGTGAAA GGGAGGTTTACCATTTCCGCTGACACCTCCAAGAACACCGCCTACCTGCAGATGAACTCACTGAG AGCCGAAGACACTGCCGTGTACTATTGCGCACGGGAGGAGTACTACTATTGGGGAGCTATGGACG TGTGGGGACAGGGAACATTGGTGACTGTGTCTTCCGGTGGCGGAGGAAGCGGAGGTGGCGGAAGC GGAGGCGGTGGAAGCGATATCCAGATGACACAGAGCCCAAGCTCACTGAGCGCTAGCGTCGGAGA TAGAGTCACCATCACCTGTAGGGCAAGCCAGAGCATCTCTAGCTACCTGGCATGGTACCAGCAGA AACCTGGCAAGGCTCCCAAGCTCCTGATCTACGGCGCTTCATCTAGAGCTAGCGGCGTTCCCTCA CGATTTAGCGGAAGCGGAAGCGGAACTGACTTCACCCTGACCATTTCAAGCCTCCAGCCTGAGGA TTTCGCCACCTACTACTGCCAGCAGTACTACTCTAGCCCACTCACATTTGGGCAGGGGACAAAGG TGGAGATCAAG |
| 861. | IGF1R24HL x I2C HL | artificial | aa | EVQLVESGGELVQPGGSLRLSCAASGFTFSSYAMSWVRQAPGKGLEWVSRISPSGGSTYYADSVK GRFTISADTSKNTAYLQMNSLRAEDTAVYYCAREEYYYWGAMDVWGQGTLVTVSSGGGGSGGGGS GGGGSDIQMTQSPSSLSASVGDRVTITCRASQSISSYLAWYQQKPGKAPKLLIYGASSRASGVPS RFSGSGSGTDFTLTISSLQPEDFATYYCQQYYSSPLTFGQGTKVEIKSGGGGSEVQLVESGGGLV QPGGSLKLSCAASGFTFNKYAMNWVRQAPGKGLEWVARIRSKYNNYATYYADSVKDRFTISRDDS KNTAYLQMNNLKTEDTAVYYCVRHGNFGNSYISYWAYWGQGTLVTVSSGGGGSGGGGSGGGGSQT VVTQEPSLTVSPGGTVTLTCGSSTGAVTSGNYPNWVQQKPGQAPRGLIGGTKFLAPGTPARFSGS LLGGKAALTLSGVQPEDEAEYYCVLWYSNRWVFGGGTKLTVL |
| 862. | IGF1R24HL x I2C HL | artificial | nt | GAAGTTCAGCTGGTGGAATCCGGGGGAGAGCTTGTTCAGCCTGGCGGATCACTTAGGCTGTCCTG TGCTGCAAGCGGCTTCACCTTCTCTAGCTATGCCATGTCATGGGTGCGACAGGCCCCTGGAAAAG GACTGGAGTGGGTCTCACGTATCTCTCCAAGTGGCGGATCCACATACTACGCCGATAGCGTGAAA GGGAGGTTTACCATTTCCGCTGACACCTCCAAGAACACCGCCTACCTGCAGATGAACTCACTGAG AGCCGAAGACACTGCCGTGTACTATTGCGCACGGGAGGAGTACTACTATTGGGGAGCTATGGACG TGTGGGGACAGGGAACATTGGTGACTGTGTCTTCCGGTGGCGGAGGAAGCGGAGGTGGCGGAAGC GGAGGCGGTGGAAGCGATATCCAGATGACACAGAGCCCAAGCTCACTGAGCGCTAGCGTCGGAGA TAGAGTCACCATCACCTGTAGGGCAAGCCAGAGCATCTCTAGCTACCTGGCATGGTACCAGCAGA AACCTGGCAAGGCTCCCAAGCTCCTGATCTACGGCGCTTCATCTAGAGCTAGCGGCGTTCCCTCA CGATTTAGCGGAAGCGGAAGCGGAACTGACTTCACCCTGACCATTTCAAGCCTCCAGCCTGAGGA TTTCGCCACCTACTACTGCCAGCAGTACTACTCTAGCCCACTCACATTTGGGCAGGGGACAAAGG TGGAGATCAAGTCCGGAGGTGGTGGATCCGAGGTGCAGCTGGTCGAGTCTGGAGGAGGATTGGTG CAGCCTGGAGGGTCATTGAAACTCTCATGTGCAGCCTCTGGATTCACCTTCAATAAGTACGCCAT GAACTGGGTCCGCCAGGCTCCAGGAAAGGGTTTGGAATGGGTTGCTCGCATAAGAAGTAAATATA ATAATTATGCAACATATTATGCCGATTCAGTGAAAGACAGGTTCACCATCTCCAGAGATGATTCA AAAAACACTGCCTATCTACAAATGAACAACTTGAAGACTGAGGACACTGCCGTGTACTACTGTGT GAGACATGGGAACTTCGGTAATAGCTACATATCCTACTGGGCTTACTGGGGCCAAGGGACTCTGG TCACCGTCTCCTCAGGTGGTGGTGGTTCTGGCGGCGGCGGCTCCGGTGGTGGTGGTTCTCAGACT GTTGTGACTCAGGAACCTTCACTCACCGTATCACCTGGTGGAACAGTCACACTCACTTGTGGCTC CTCGACTGGGGCTGTTACATCTGGCAACTACCCAAACTGGGTCCAACAAAAACCAGGTCAGGCAC CCCGTGGTCTAATAGGTGGGACTAAGTTCCTCGCCCCCGGTACTCCTGCCAGATTCTCAGGCTCC CTGCTTGGAGGCAAGGCTGCCCTCACCCTCTCAGGGGTACAGCCAGAGGATGAGGCAGAATATTA CTGTGTTCTATGGTACAGCAACCGCTGGGTGTTCGGTGGAGGAACCAAACTGACTGTCCTA |
| 863. | Macaca fascicularis CD3epsilon 1-27 | Macaca fascicularis | aa | QDGNEEMGSITQTPYQVSISGTTILTC |
| 864. | Macaca fascicularis CD3epsilon 1-27 | Macaca fascicularis | aa | QDGNEEMGSITQTPYQVSISGTTVILT |
| 865. | Macaca mulatta CD3epsilon 1-27 | Macaca mulatta | aa | QDGNEEMGSITQTPYHVSISGTTVILT |

SEQUENCE LISTING (865 sequences)

SEQ ID NO: 1 - protein, 105 aa, Homo sapiens
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 2 - protein, 27 aa, Homo sapiens
QDGNEEMGGITQTPYKVSISGTTVILT

SEQ ID NO: 3 - protein, 96 aa, Callithrix jacchus
QDGNEEMGDTTQNPYKVSISGTTVTLTCPRYDGHEIKWLVNSQNKEGHEDHLLLEDFSEMEQSGYYACLSKETPAEEASHYLYLKARVCENCVEVD

SEQ ID NO: 4 - protein, 27 aa, Callithrix jacchus
QDGNEEMGDTTQNPYKVSISGTTVTLT

SEQ ID NO: 5 - protein, 96 aa, Saguinus oedipus; identical to SEQ ID NO: 3

SEQ ID NO: 6 - protein, 27 aa, Saguinus oedipus
QDGNEEMGDTTQNPYKVSISGTTVTLT

SEQ ID NO: 7 - protein, 96 aa, Saimiri sciureus
QDGNEEIGDTTQNPYKVSISGTTVTLTCPRYDGQEIKWLVNDQNKEGHEDHLLLEDFSEMEQSGYYACLSKETPTEEASHYLYLKARVCENCVEVD

SEQ ID NO: 8 - protein, 27 aa, Saimiri sciureus
QDGNEEIGDTTQNPYKVSISGTTVTLT

SEQ ID NO: 9 - protein, 14 aa, Artificial Sequence
  CDR-L1 of F6A
GSSTGAVTSGYYPN

SEQ ID NO: 10 - protein, 7 aa, Artificial Sequence
  CDR-L2 of F6A
GTKFLAP

SEQ ID NO: 11 - protein, 9 aa, Artificial Sequence
  CDR-L3 of F6A
ALWYSNRWV

SEQ ID NO: 12 - protein, 5 aa, Artificial Sequence
  CDR-H1 of F6A
IYAMN

SEQ ID NO: 13 - protein, 19 aa, Artificial Sequence
  CDR-H2 of F6A
RIRSKYNNYATYYADSVKS

SEQ ID NO: 14 - protein, 14 aa, Artificial Sequence
  CDR-H3 of F6A
HGNFGNSYVSFFAY

SEQ ID NO: 15 - protein, 125 aa, Artificial Sequence
  VH of F6A
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 16 - DNA, 375 bp, Artificial Sequence
  VH of F6A
gaggtgcagctggtcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctca

SEQ ID NO: 17 - protein, 109 aa, Artificial Sequence
  VL of F6A
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 18 - DNA, 327 bp, Artificial Sequence
  VL of F6A
cagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 19 - protein, 125 aa, Artificial Sequence
  VH-P of F6A
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 20 - DNA, 375 bp, Artificial Sequence
  VH-P of F6A
gaggtgcagctgctcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctca

SEQ ID NO: 21 - protein, 109 aa, Artificial Sequence
  VL-P of F6A
ELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 22 - DNA, 327 bp, Artificial Sequence
  VL-P of F6A
gagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 23 - protein, 249 aa, Artificial Sequence
  VH-VL of F6A
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 24 - DNA, 747 bp, Artificial Sequence
  VH-VL of F6A
gaggtgcagctggtcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 25 - protein, 249 aa, Artificial Sequence
  VH-VL-P of F6A
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 26 - DNA, 747 bp, Artificial Sequence
  VH-VL-P of F6A
gaggtgcagctgctcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 27 - protein, 14 aa, Artificial Sequence
  CDR-L1 of H2C
GSSTGAVTSGYYPN

SEQ ID NO: 28 - protein, 7 aa, Artificial Sequence
  CDR-L2 of H2C
GTKFLAP

SEQ ID NO: 29 - protein, 9 aa, Artificial Sequence
  CDR-L3 of H2C
ALWYSNRWV

SEQ ID NO: 30 - protein, 5 aa, Artificial Sequence
  CDR-H1 of H2C
KYAMN

SEQ ID NO: 31 - protein, 19 aa, Artificial Sequence
  CDR-H2 of H2C
RIRSKYNNYATYYADSVKD

SEQ ID NO: 32 - protein, 14 aa, Artificial Sequence
  CDR-H3 of H2C
HGNFGNSYISYWAY

SEQ ID NO: 33 - protein, 125 aa, Artificial Sequence
  VH of H2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 34 - DNA, 375 bp, Artificial Sequence
  VH of H2C
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctca

SEQ ID NO: 35 - protein, 109 aa, Artificial Sequence; identical to SEQ ID NO: 17
  VL of H2C

SEQ ID NO: 36 - DNA, 327 bp, Artificial Sequence; identical to SEQ ID NO: 18
  VL of H2C

SEQ ID NO: 37 - protein, 125 aa, Artificial Sequence
  VH-P of H2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 38 - DNA, 375 bp, Artificial Sequence
  VH-P of H2C
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctca

SEQ ID NO: 39 - protein, 109 aa, Artificial Sequence; identical to SEQ ID NO: 21
  VL-P of H2C

SEQ ID NO: 40 - DNA, 327 bp, Artificial Sequence; identical to SEQ ID NO: 22
  VL-P of H2C

SEQ ID NO: 41 - protein, 249 aa, Artificial Sequence
  VH-VL of H2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 42 - DNA, 747 bp, Artificial Sequence
  VH-VL of H2C
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 43 - protein, 249 aa, Artificial Sequence
  VH-VL-P of H2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 44 - DNA, 747 bp, Artificial Sequence
  VH-VL-P of H2C
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 45 - protein, 14 aa, Artificial Sequence
  CDR-L1 of H1E
GSSTGAVTSGYYPN

SEQ ID NO: 46 - protein, 7 aa, Artificial Sequence
  CDR-L2 of H1E
GTKFLAP

SEQ ID NO: 47 - protein, 9 aa, Artificial Sequence
  CDR-L3 of H1E
ALWYSNRWV

SEQ ID NO: 48 - protein, 5 aa, Artificial Sequence
  CDR-H1 of H1E
SYAMN

SEQ ID NO: 49 - protein, 19 aa, Artificial Sequence
  CDR-H2 of H1E
RIRSKYNNYATYYADSVKG

SEQ ID NO: 50 - protein, 14 aa, Artificial Sequence
  CDR-H3 of H1E
HGNFGNSYLSFWAY

SEQ ID NO: 51 - protein, 125 aa, Artificial Sequence
  VH of H1E
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 52 - DNA, 374 bp, Artificial Sequence
  VH of H1E
gaggtgcagctggtcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctc

SEQ ID NO: 53 - protein, 109 aa, Artificial Sequence; identical to SEQ ID NO: 17
  VL of H1E

SEQ ID NO: 54 - DNA, 327 bp, Artificial Sequence; identical to SEQ ID NO: 18
  VL of H1E

SEQ ID NO: 55 - protein, 125 aa, Artificial Sequence
  VH-P of H1E
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 56 - DNA, 375 bp, Artificial Sequence
  VH-P of H1E
gaggtgcagctgctcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctca

SEQ ID NO: 57 - protein, 109 aa, Artificial Sequence; identical to SEQ ID NO: 21
  VL-P of H1E

SEQ ID NO: 58 - DNA, 327 bp, Artificial Sequence; identical to SEQ ID NO: 22
  VL-P of H1E

SEQ ID NO: 59 - protein, 249 aa, Artificial Sequence
  VH-VL of H1E
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 60 - DNA, 747 bp, Artificial Sequence
  VH-VL of H1E
gaggtgcagctggtcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 61 - protein, 249 aa, Artificial Sequence
  VH-VL-P of H1E
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 62 - DNA, 747 bp, Artificial Sequence
  VH-VL-P of H1E
gaggtgcagctgctcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 63 - protein, 14 aa, Artificial Sequence
  CDR-L1 of G4H
GSSTGAVTSGYYPN

SEQ ID NO: 64 - protein, 7 aa, Artificial Sequence
  CDR-L2 of G4H
GTKFLAP

SEQ ID NO: 65 - protein, 9 aa, Artificial Sequence
  CDR-L3 of G4H
ALWYSNRWV

SEQ ID NO: 66 - protein, 5 aa, Artificial Sequence
  CDR-H1 of G4H
RYAMN

SEQ ID NO: 67 - protein, 19 aa, Artificial Sequence
  CDR-H2 of G4H
RIRSKYNNYATYYADSVKG

SEQ ID NO: 68 - protein, 14 aa, Artificial Sequence
  CDR-H3 of G4H
HGNFGNSYLSYFAY

SEQ ID NO: 69 - protein, 125 aa, Artificial Sequence
  VH of G4H
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 70 - DNA, 375 bp, Artificial Sequence
  VH of G4H
gaggtgcagctggtcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctca

SEQ ID NO: 71 - protein, 109 aa, Artificial Sequence; identical to SEQ ID NO: 17
  VL of G4H

SEQ ID NO: 72 - DNA, 327 bp, Artificial Sequence; identical to SEQ ID NO: 18
  VL of G4H

SEQ ID NO: 73 - protein, 125 aa, Artificial Sequence
  VH-P of G4H
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 74 - DNA, 375 bp, Artificial Sequence
  VH-P of G4H
gaggtgcagctgctcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctca

SEQ ID NO: 75 - protein, 109 aa, Artificial Sequence; identical to SEQ ID NO: 21
  VL-P of G4H

SEQ ID NO: 76 - DNA, 327 bp, Artificial Sequence; identical to SEQ ID NO: 22
  VL-P of G4H

SEQ ID NO: 77 - protein, 249 aa, Artificial Sequence
  VH-VL of G4H
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 78 - DNA, 747 bp, Artificial Sequence
  VH-VL of G4H
gaggtgcagctggtcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 79 - protein, 249 aa, Artificial Sequence
  VH-VL-P of G4H
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 80 - DNA, 747 bp, Artificial Sequence
  VH-VL-P of G4H
gaggtgcagctgctcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 81 - protein, 14 aa, Artificial Sequence
  CDR-L1 of A2J
RSSTGAVTSGYYPN

SEQ ID NO: 82 - protein, 7 aa, Artificial Sequence
  CDR-L2 of A2J
ATDMRPS

SEQ ID NO: 83 - protein, 9 aa, Artificial Sequence
  CDR-L3 of A2J
ALWYSNRWV

SEQ ID NO: 84 - protein, 5 aa, Artificial Sequence
  CDR-H1 of A2J
VYAMN

SEQ ID NO: 85 - protein, 19 aa, Artificial Sequence
  CDR-H2 of A2J
RIRSKYNNYATYYADSVKK

SEQ ID NO: 86 - protein, 14 aa, Artificial Sequence
  CDR-H3 of A2J
HGNFGNSYLSWWAY

SEQ ID NO: 87 - protein, 125 aa, Artificial Sequence
  VH of A2J
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 88 - DNA, 375 bp, Artificial Sequence
  VH of A2J
gaggtgcagctggtcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctca

SEQ ID NO: 89 - protein, 109 aa, Artificial Sequence
  VL of A2J
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 90 - DNA, 327 bp, Artificial Sequence
  VL of A2J
cagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 91 - protein, 125 aa, Artificial Sequence
  VH-P of A2J
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 92 - DNA, 375 bp, Artificial Sequence
  VH-P of A2J
gaggtgcagctgctcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctca

SEQ ID NO: 93 - protein, 109 aa, Artificial Sequence
  VL-p of A2J
ELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 94 - DNA, 327 bp, Artificial Sequence
  VL-P of A2J
gagctcgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 95 - protein, 249 aa, Artificial Sequence
  VH-VL of A2J
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 96 - DNA, 747 bp, Artificial Sequence
  VH-VL of A2J
gaggtgcagctggtcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 97 - protein, 249 aa, Artificial Sequence
  VH-VL-P of A2J
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 98 - DNA, 747 bp, Artificial Sequence
  VH-VL-P of A2J
gaggtgcagctgctcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 99 - protein, 14 aa, Artificial Sequence
  CDR-L1 of E1L
GSSTGAVTSGYYPN

SEQ ID NO: 100 - protein, 7 aa, Artificial Sequence
  CDR-L2 of E1L
GTKFLAP

SEQ ID NO: 101 - protein, 9 aa, Artificial Sequence
  CDR-L3 of E1L
ALWYSNRWV

SEQ ID NO: 102 - protein, 5 aa, Artificial Sequence
  CDR-H1 of E1L
KYAMN

SEQ ID NO: 103 - protein, 19 aa, Artificial Sequence
  CDR-H2 of E1L
RIRSKYNNYATYYADSVKS

SEQ ID NO: 104 - protein, 14 aa, Artificial Sequence
  CDR-H3 of E1L
HGNFGNSYTSYYAY

SEQ ID NO: 105 - protein, 125 aa, Artificial Sequence
  VH of E1L
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 106 - DNA, 375 bp, Artificial Sequence
  VH of E1L
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctca

SEQ ID NO: 107 - protein, 109 aa, Artificial Sequence; identical to SEQ ID NO: 17
  VL of E1L

SEQ ID NO: 108 - DNA, 327 bp, Artificial Sequence; identical to SEQ ID NO: 18
  VL of E1L

SEQ ID NO: 109 - protein, 125 aa, Artificial Sequence
  VH-P of E1L
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 110 - DNA, 375 bp, Artificial Sequence
  VH-P of E1L
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctca

SEQ ID NO: 111 - protein, 109 aa, Artificial Sequence; identical to SEQ ID NO: 21
  VL-P of E1L

SEQ ID NO: 112 - DNA, 327 bp, Artificial Sequence; identical to SEQ ID NO: 22
  VL-P of E1L

SEQ ID NO: 113 - protein, 249 aa, Artificial Sequence
  VH-VL of E1L
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 114 - DNA, 747 bp, Artificial Sequence
  VH-VL of E1L
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 115 - protein, 249 aa, Artificial Sequence
  VH-VL-P of E1L
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 116 - DNA, 747 bp, Artificial Sequence
  VH-VL-P of E1L
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 117 - protein, 14 aa, Artificial Sequence
  CDR-L1 of E2M
RSSTGAVTSGYYPN

SEQ ID NO: 118 - protein, 7 aa, Artificial Sequence
  CDR-L2 of E2M
ATDMRPS

SEQ ID NO: 119 - protein, 9 aa, Artificial Sequence
  CDR-L3 of E2M
ALWYSNRWV

SEQ ID NO: 120 - protein, 5 aa, Artificial Sequence
  CDR-H1 of E2M
GYAMN

SEQ ID NO: 121 - protein, 19 aa, Artificial Sequence
  CDR-H2 of E2M
RIRSKYNNYATYYADSVKE

SEQ ID NO: 122 - protein, 14 aa, Artificial Sequence
  CDR-H3 of E2M
HRNFGNSYLSWFAY

SEQ ID NO: 123 - protein, 125 aa, Artificial Sequence
  VH of E2M
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 124 - DNA, 375 bp, Artificial Sequence
  VH of E2M
gaggtgcagctggtcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctca

SEQ ID NO: 125 - protein, 109 aa, Artificial Sequence; identical to SEQ ID NO: 89
  VL of E2M

SEQ ID NO: 126 - DNA, 327 bp, Artificial Sequence; identical to SEQ ID NO: 90
  VL of E2M

SEQ ID NO: 127 - protein, 125 aa, Artificial Sequence
  VH-P of E2M
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 128 - DNA, 375 bp, Artificial Sequence
  VH-P of E2M
gaggtgcagctgctcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctca

SEQ ID NO: 129 - protein, 109 aa, Artificial Sequence; identical to SEQ ID NO: 93
  VL-P of E2M

SEQ ID NO: 130 - DNA, 327 bp, Artificial Sequence; identical to SEQ ID NO: 94
  VL-P of E2M

SEQ ID NO: 131 - protein, 249 aa, Artificial Sequence
  VH-VL of E2M
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 132 - DNA, 747 bp, Artificial Sequence
  VH-VL of E2M
gaggtgcagctggtcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 133 - protein, 249 aa, Artificial Sequence
  VH-VL-P of E2M
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 134 - DNA, 747 bp, Artificial Sequence
  VH-VL-P of E2M
gaggtgcagctgctcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 135 - protein, 14 aa, Artificial Sequence
  CDR-L1 of F7O
GSSTGAVTSGYYPN

SEQ ID NO: 136 - protein, 7 aa, Artificial Sequence
  CDR-L2 of F7O
GTKFLAP

SEQ ID NO: 137 - protein, 9 aa, Artificial Sequence
  CDR-L3 of F7O
ALWYSNRWV

SEQ ID NO: 138 - protein, 5 aa, Artificial Sequence
  CDR-H1 of F7O
VYAMN

SEQ ID NO: 139 - protein, 19 aa, Artificial Sequence
  CDR-H2 of F7O
RIRSKYNNYATYYADSVKK

SEQ ID NO: 140 - protein, 14 aa, Artificial Sequence
  CDR-H3 of F7O
HGNFGNSYISWWAY

SEQ ID NO: 141 - protein, 125 aa, Artificial Sequence
  VH of F7O
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 142 - DNA, 375 bp, Artificial Sequence
  VH of F7O
gaggtgcagctggtcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctca

SEQ ID NO: 143 - protein, 109 aa, Artificial Sequence; identical to SEQ ID NO: 17
  VL of F7O

SEQ ID NO: 144 - DNA, 327 bp, Artificial Sequence; identical to SEQ ID NO: 18
  VL of F7O

SEQ ID NO: 145 - protein, 125 aa, Artificial Sequence
  VH-P of F7O
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 146 - DNA, 375 bp, Artificial Sequence
  VH-P of F7O
gaggtgcagctgctcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctca

SEQ ID NO: 147 - protein, 109 aa, Artificial Sequence; identical to SEQ ID NO: 21
  VL-P of F7O

SEQ ID NO: 148 - DNA, 327 bp, Artificial Sequence; identical to SEQ ID NO: 22
  VL-P of F7O

SEQ ID NO: 149 - protein, 249 aa, Artificial Sequence
  VH-VL of F7O
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 150 - DNA, 747 bp, Artificial Sequence
  VH-VL of F7O
gaggtgcagctggtcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 151 - protein, 249 aa, Artificial Sequence
  VH-VL-P of F7O
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 152 - DNA, 747 bp, Artificial Sequence
  VH-VL-P of F7O
gaggtgcagctgctcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 153 - protein, 14 aa, Artificial Sequence
  CDR-L1 of F12Q
GSSTGAVTSGNYPN

SEQ ID NO: 154 - protein, 7 aa, Artificial Sequence
  CDR-L2 of F12Q
GTKFLAP

SEQ ID NO: 155 - protein, 9 aa, Artificial Sequence
  CDR-L3 of F12Q
VLWYSNRWV

SEQ ID NO: 156 - protein, 5 aa, Artificial Sequence
  CDR-H1 of F12Q
SYAMN

SEQ ID NO: 157 - protein, 19 aa, Artificial Sequence
  CDR-H2 of F12Q
RIRSKYNNYATYYADSVKG

SEQ ID NO: 158 - protein, 14 aa, Artificial Sequence
  CDR-H3 of F12Q
HGNFGNSYVSWWAY

SEQ ID NO: 159 - protein, 125 aa, Artificial Sequence
  VH of F12Q
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 160 - DNA, 375 bp, Artificial Sequence
  VH of F12Q
gaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctca

SEQ ID NO: 161 - protein, 109 aa, Artificial Sequence
  VL of F12Q
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 162 - DNA, 327 bp, Artificial Sequence
  VL of F12Q
cagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 163 - protein, 125 aa, Artificial Sequence
  VH-P of F12Q
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 164 - DNA, 375 bp, Artificial Sequence
  VH-P of F12Q
gaggtgcagctgctcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctca

SEQ ID NO: 165 - protein, 109 aa, Artificial Sequence
  VL-P of F12Q
ELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 166 - DNA, 327 bp, Artificial Sequence
  VL-P of F12Q
gagctcgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 167 - protein, 249 aa, Artificial Sequence
  VH-VL of F12Q
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 168 - DNA, 747 bp, Artificial Sequence
  VH-VL of F12Q
gaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 169 - protein, 249 aa, Artificial Sequence
  VH-VL-P of F12Q
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 170 - DNA, 747 bp, Artificial Sequence
  VH-VL-P of F12Q
gaggtgcagctgctcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 171 - protein, 14 aa, Artificial Sequence
  CDR-L1 of I2C
GSSTGAVTSGNYPN

SEQ ID NO: 172 - protein, 7 aa, Artificial Sequence
  CDR-L2 of I2C
GTKFLAP

SEQ ID NO: 173 - protein, 9 aa, Artificial Sequence
  CDR-L3 of I2C
VLWYSNRWV

SEQ ID NO: 174 - protein, 5 aa, Artificial Sequence
  CDR-H1 of I2C
KYAMN

SEQ ID NO: 175 - protein, 19 aa, Artificial Sequence
  CDR-H2 of I2C
RIRSKYNNYATYYADSVKD

SEQ ID NO: 176 - protein, 14 aa, Artificial Sequence
  CDR-H3 of I2C
HGNFGNSYISYWAY

SEQ ID NO: 177 - protein, 125 aa, Artificial Sequence; identical to SEQ ID NO: 33
  VH of I2C

SEQ ID NO: 178 - DNA, 375 bp, Artificial Sequence; identical to SEQ ID NO: 34
  VH of I2C

SEQ ID NO: 179 - protein, 109 aa, Artificial Sequence; identical to SEQ ID NO: 161
  VL of I2C

SEQ ID NO: 180 - DNA, 327 bp, Artificial Sequence; identical to SEQ ID NO: 162
  VL of I2C

SEQ ID NO: 181 - protein, 125 aa, Artificial Sequence; identical to SEQ ID NO: 37
  VH-P of I2C

SEQ ID NO: 182 - DNA, 375 bp, Artificial Sequence; identical to SEQ ID NO: 38
  VH-P of I2C

SEQ ID NO: 183 - protein, 109 aa, Artificial Sequence; identical to SEQ ID NO: 165
  VL-P of I2C

SEQ ID NO: 184 - DNA, 327 bp, Artificial Sequence; identical to SEQ ID NO: 166
  VL-P of I2C

SEQ ID NO: 185 - protein, 249 aa, Artificial Sequence
  VH-VL of I2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 186 - DNA, 747 bp, Artificial Sequence
  VH-VL of I2C
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 187 - protein, 249 aa, Artificial Sequence
  VH-VL-P of I2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 188 - DNA, 747 bp, Artificial Sequence
  VH-VL-P of I2C
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 189 - DNA, 3096 bp, Artificial Sequence
  EpCAM-D1-hNG2
atgggatggagctgtatcatcctcttcttggtagcaacagctacaggtgtacactccacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattttcaatgcagggtctaaaaggcgtacactccgactacaaagacgatgacgacaagtccgtacactccgcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctcgagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggccattatgaagctttctccaccctggctcccgaggcttggccagccatggagctgcctgagccatgcgtgcctgagccagggctgcctcctgtctttgccaatttcacccagctgctgactatcagcccactagtggtggccgagggtggcacagcctggcttgagtggaggcatgtgcagcccacgctggacctgatggaggctgagctgcgcaaatcccaggtgctgttcagcgtgacccgaggggcacactatggcgagctcgagctggacatcctgggtgcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccactgcggtggtcctgcacaggacttgacgttccgggtcagcgatggactgcaggccagccccccggccacgctgaaggtggtggccatccggccggccatacagatccacagatctcaattgtttctagaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtga

SEQ ID NO: 190 - protein, 1031 aa, Artificial Sequence [sequence omitted]

SEQ ID NO: 191 - DNA, 3219 bp, Artificial Sequence
  EpCAM-D3-hNG2
atgggatggagctgtatcatcctcttcttggtagcaacagctacaggtgtacactccacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattttcaatgcagggtctaaaaggcgtacactccgactacaaagacgatgacgacaagtcccgtacgagatctggatcccaattggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccgcggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccggttgatccagggaccccagtatgggcatctcctggtgggcgggcggcccacctcggccttcagccaattccagatagaccagggcgaggtggtctttgccttcaccaactcctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacagacagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagctttctagaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtga

SEQ ID NO: 192 - protein, 1072 aa, Artificial Sequence
  EpCAM-D3-hNG2
MGWSCIILFLVATATGVHSTATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKGVHSDYKDDDDKSRTRSGSQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNSSSSHDHFRVLALARGVNASAVVNVTVRALLHVWAGGPWPQGATLRLDPTVLDAGELANRTDSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 193 - DNA, 5127 bp, Artificial Sequence
  EpCAM-D1D3-hNG2
atgggatggagctgtatcatcctcttcttggtagcaacagctacaggtgtacactccacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattttcaatgcagggtctaaaaggcgtacactccgactacaaagacgatgacgacaagtccgtacactccgcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctcgagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggccattatgaagctttctccaccctggctcccgaggcttggccagccatggagctgcctgagccatgcgtgcctgagccagggctgcctcctgtctttgccaatttcacccagctgctgactatcagcccactagtggtggccgagggtggcacagcctggcttgagtggaggcatgtgcagcccacgctggacctgatggaggctgagctgcgcaaatcccaggtgctgttcagcgtgacccgaggggcacactatggcgagctcgagctggacatcctgggtgcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccactgcggtggtcctgcacaggacttgacgttccgggtcagcgatggactgcaggccagccccccggccacgctgaaggtggtggccatccggccggccatacagatccacagatctcaattggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccgcggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccggttgatccagggaccccagtatgggcatctcctggtgggcgggcggcccacctcggccttcagccaattccagatagaccagggcgaggtggtctttgccttcaccaactcctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacagacagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagctttctagaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtga

SEQ ID NO: 194 - protein, 1708 aa, Artificial Sequence [sequence omitted]

SEQ ID NO: 195 - DNA, 5703 bp, Artificial Sequence
  EpCAM-D1D2-hNG2
atgggatggagctgtatcatcctcttcttggtagcaacagctacaggtgtacactccacagcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattttcaatgcagggtctaaaaggcgtacactccgactacaaagacgatgacgacaagtccgtacactccgcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctcgagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggccattatgaagctttctccaccctggctcccgaggcttggccagccatggagctgcctgagccatgcgtgcctgagccagggctgcctcctgtctttgccaatttcacccagctgctgactatcagcccactagtggtggccgagggtggcacagcctggcttgagtggaggcatgtgcagcccacgctggacctgatggaggctgagctgcgcaaatcccaggtgctgttcagcgtgacccgaggggcacactatggcgagctcgagctggacatcctgggtgcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccactgcggtggtcctgcacaggacttgacgttccgggtcagcgatggactgcaggccagccccccggccacgctgaaggtggtggccatccggccggccatacagatccacagatctacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcatagtacaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagctcgtgcctcagaggcagtcgaggacaccttccgtttccgtgtcacggcgccaccatatttctccccactctataccttccccatccacattggtggtgacccagatgcgcctgtcctcaccaatgtcctcctcgtggtgcctgagggtggtgagggtgtcctctctgctgaccacctctttgtcaagagtctcaacagtgccagctacctctatgaggtcatggagcggccccgccttgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacaactagtccgggctggtcagccagccacagccttctcccagcaggacctgctggatggggccgttctctatagccacaatggcagcctcagccccgaagacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactctagacctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggacccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccaattgtttctagaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtga

SEQ ID NO: 196 - protein, 1900 aa, Artificial Sequence
  EpCAM-D1D2-hNG2
MGWSCIILFLVATATGVHSTATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKGVHSDYKDDDDKSVHSASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGAHYGELELDILGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHCGGPAQDLTFRVSDGLQASPPATLKVVAIRPAIQIHRSTGLRLAQGSAMPILPANLSVETNAVGQDVSVLFRVTGALQFGELQKHSTGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRLGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPEDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGPLQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 197 - DNA, 7734 bp, Artificial Sequence
  EpCAM-hNG2
atgggatggagctgtatcatcctcttcttggtagcaacagctacaggtgtacactccacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattttcaatgcagggtctaaaaggcgtacactccgactacaaagacgatgacgacaagtccgtacactccgcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctcgagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggccattatgaagctttctccaccctggctcccgaggcttggccagccatggagctgcctgagccatgcgtgcctgagccagggctgcctcctgtctttgccaatttcacccagctgctgactatcagcccactagtggtggccgagggtggcacagcctggcttgagtggaggcatgtgcagcccacgctggacctgatggaggctgagctgcgcaaatcccaggtgctgttcagcgtgacccgaggggcacactatggcgagctcgagctggacatcctgggtgcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccactgcggtggtcctgcacaggacttgacgttccgggtcagcgatggactgcaggccagccccccggccacgctgaaggtggtggccatccggccggccatacagatccacagatctacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcatagtacaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagctcgtgcctcagaggcagtcgaggacaccttccgtttccgtgtcacggcgccaccatatttctccccactctataccttccccatccacattggtggtgacccagatgcgcctgtcctcaccaatgtcctcctcgtggtgcctgagggtggtgagggtgtcctctctgctgaccacctctttgtcaagagtctcaacagtgccagctacctctatgaggtcatggagcggccccgccttgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacaactagtccgggctggtcagccagccacagccttctcccagcaggacctgctggatggggccgttctctatagccacaatggcagcctcagccccgaagacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactctagacctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggacccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccaattggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccgcggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccggttgatccagggaccccagtatgggcatctcctggtgggcgggcggcccacctcggccttcagccaattccagatagaccagggcgaggtggtctttgccttcaccaactcctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacagacagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagctttctagaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtga

SEQ ID NO: 198 - protein, 2577 aa, Artificial Sequence [sequence omitted]

SEQ ID NO: 199 - DNA, 1506 bp, Artificial Sequence
  5-10 x I2C
gagctcgtgatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagcttgagatcaaaggtggtggtggttctggcggcggcggctccggtggtggtggttctgaggtgcagctgctcgagcagtctggagctgagctggtaaggcctgggacttcagtgaagatatcctgcaaggcttctggatacgccttcactaactactggctaggttgggtaaagcagaggcctggacatggacttgagtggattggagatattttccctggaagtggtaatatccactacaatgagaagttcaagggcaaagccacactgactgcagacaaatcttcgagcacagcctatatgcagctcagtagcctgacatttgaggactctgctgtctatttctgtgcaagactgaggaactgggacgagcctatggactactggggccaagggaccacggtcaccgtctcctccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 200 - protein, 502 aa, Artificial Sequence
  5-10 x I2C
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 201 - DNA, 2253 bp, Artificial Sequence
  human PSMA construct
atgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 202 - protein, 750 aa, Artificial Sequence
  human PSMA construct
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 203 - DNA, 3489 bp, Artificial Sequence
  soluble fusion protein of h PSMA and m Lag3
atgagggaggacctgctccttggctttttgcttctgggactgctttgggaagctccagttgtgtcttcagggcctgggaaagagctccccgtggtgtgggcccaggagggagctcccgtccatcttccctgcagcctcaaatcccccaacctggatcctaactttctacgaagaggaggggttatctggcaacatcaaccagacagtggccaacccactcccatcccggcccttgaccttcaccaggggatgccctcgcctagacaacccgcacccggtcgctacacggtgctgagcgtggctccaggaggcctgcgcagcgggaggcagcccctgcatccccacgtgcagctggaggagcgcggcctccagcgcggggacttctctctgtggttgcgcccagctctgcgcaccgatgcgggcgagtaccacgccaccgtgcgcctcccgaaccgcgccctctcctgcagtctccgcctgcgcgtcggccaggcctcgatgattgctagtccctcaggagtcctcaagctgtctgattgggtccttttgaactgctccttcagccgtcctgaccgcccagtctctgtgcactggttccagggccagaaccgagtgcctgtctacaactcaccgcgtcattttttagctgaaactttcctgttactgccccaagtcagccccctggactctgggacctggggctgtgtcctcacctacagagatggcttcaatgtctccatcacgtacaacctcaaggttctgggtctggagcccgtagcccctctgacagtgtacgctgctgaaggttctagggtggagctgccctgtcatttgcccccaggagtggggaccccttctttgctcattgccaagtggactcctcctggaggaggtcctgagctccccgtggctggaaagagtggcaattttacccttcaccttgaggctgtgggtctggcacaggctgggacctacacctgtagcatccatctgcagggacagcagctcaatgccactgtcacgttggcggtcatcacagtgactcccaaatccttcgggttacctggctcccgggggaagctgttgtgtgaggtaaccccggcatctggaaaggaaagatttgtgtggcgtcccctgaacaatctgtccaggagttgcccgggccctgtgctggagattcaggaggccaggctccttgctgagcgatggcagtgtcagctgtacgagggccagaggcttcttggagcgacagtgtacgccgcagagtctagctcaggcgcccacagtgctaggagaatctcaggtgaccttaaaggaggccattccggaggtggtggatccaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctccgggcatcatcaccatcatcattga

SEQ ID NO: 204 - protein, 1162 aa, Artificial Sequence
  soluble fusion protein of h PSMA and m Lag3
MREDLLLGFLLLGLLWEAPVVSSGPGKELPVVWAQEGAPVHLPCSLKSPNLDPNFLRRGGVIWQHQPDSGQPTPIPALDLHQGMPSPRQPAPGRYTVLSVAPGGLRSGRQPLHPHVQLEERGLQRGDFSLWLRPALRTDAGEYHATVRLPNRALSCSLRLRVGQASMIASPSGVLKLSDWVLLNCSFSRPDRPVSVHWFQGQNRVPVYNSPRHFLAETFLLLPQVSPLDSGTWGCVLTYRDGFNVSITYNLKVLGLEPVAPLTVYAAEGSRVELPCHLPPGVGTPSLLIAKWTPPGGGPELPVAGKSGNFTLHLEAVGLAQAGTYTCSIHLQGQQLNATVTLAVITVTPKSFGLPGSRGKLLCEVTPASGKERFVWRPLNNLSRSCPGPVLEIQEARLLAERWQCQLYEGQRLLGATVYAAESSSGAHSARRISGDLKGGHSGGGGSKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVASGHHHHHH

SEQ ID NO: 205 - DNA, 2289 bp, Artificial Sequence
  rat PSMA construct
atgtggaacgctcagcaggacagcgactccgcggaggccctgggacgccgccaacgctggttctgtgctggaacactggtgctggctttcactggaaccttcatcattggcttcctctttgggtggtttataaaaccctccaatgattctactagcagtgtttcctatcctggcatgaagaaggcatttttgcaagaattgaaggctgagaacatcaaaaaatttttatacaatttcacacggacaccacatttggcagggacacaacacaattttgagcttgcaaagcaaattcatgcccagtggaaagaatttggcctggatttggttgagttatctgattatgatgtcctgttgtcctacccaaataagacccatcccaactatatctcaataattaatgaagatggaaatgagattttcaaaacatcattagctgaactgtcacccccgggatatgagaacatatcagatgtagtgccaccatacagtgccttctctccacaagggacaccagagggggatctagtatatgttaactatgcacgaactgaagacttctttaaactggaacgggtcatgaagatcaattgttctgggaagattgtcatcgccagatatgggcaagtgttcagaggaaataaggttaaaaatgctcagctggcaggtgcaaaaggaatcattctgtactcagaccctgctgattactttgttcctggggtgaagtcctatccagatggttggaacctccctggaggtggtgttcagcgtggaaatgtcttaaatcttaatggtgcaggtgatcccctcacaccaggttatccagcaaatgaatatgcctacaggcatgagttcacagaagctgtcggtcttccaagtattcctgtccatccaattggatatgatgatgcacagaaactattagaacatatgggtggctccgcaccccctgacagcagctggaagggaggactaaaagtgccttacaacgtgggacctggctttgctggaaacttttcaaaacaaaaggtcaagctgcatattcactcctacaataaagtgacaagaatctacaatgttattggtaccctcaaaggagctgtggaaccagacagatatgttattcttggagggcacagagatgcttgggtgtttggtggcattgaccctcagagtggagcagctgttgttcatgaaattgtcaggacctttggaactctgaagaagaaaggttggaggcctagaagaactattttgtttgcaagctgggatgctgaagaatttggccttcttggttctactgagtgggcagaggaacattcaagactcttacaagaacgtggtgtggcttatatcaacgctgattcttccatagaaggaaactacactctcagagttgattgcacaccactgatgcacagcttagtatacaacctaacaaaagagctgccaagcccggatgaaggctttgaaggcaaatctctttatgacagctggaaagaaaaaagtccttcaactgagttcattggaatgccaaggattagcaagctggggtctggcaatgattttgaagtgtttttccaaagacttggaattgcttcaggcagagcccggtatactaaaaattggaaaaacaacaaagtcagcagctatcctctctatcacagtgtctatgaaacatacgaattggtagaaaaattctatgatccgacatttaaatatcacctcactgtggcccaggttcgaggagcaatggtatttgaattggccaattctatagtgcttccctttgactgccaaagttatgctgtagctctgaagaaacatgctgagactatctacaacatttcaatgaatcatccacaggagatgaaggcgtacatgatatcatttgattcgctgttttctgcagtaaataattttacagatgttgcatccaagttcaatcagagactgcaagacttagacaagagcaaccccatattactgagaattttgaatgatcagctaatgtatctggaacgtgcattcattgatcctttaggattaccaggaaggcctttctacaggcatatcatctatgctccaagcagccacaacaagtatgcaggagaatcattcccagggatttatgatgccctttttgatattaataacaaagtcgatacttctaaggcctggagagaagtgaagagacagatttctattgcagccttcacagtgcaagctgcagcagagactctgagagaagtagactccggggattacaaggacgacgatgacaagtag

SEQ ID NO: 206 - protein, 762 aa, Artificial Sequence
  rat PSMA construct
MWNAQQDSDSAEALGRRQRWFCAGTLVLAFTGTFIIGFLFGWFIKPSNDSTSSVSYPGMKKAFLQELKAENIKKFLYNFTRTPHLAGTQHNFELAKQIHAQWKEFGLDLVELSDYDVLLSYPNKTHPNYISIINEDGNEIFKTSLAELSPPGYENISDVVPPYSAFSPQGTPEGDLVYVNYARTEDFFKLERVMKINCSGKIVIARYGQVFRGNKVKNAQLAGAKGIILYSDPADYFVPGVKSYPDGWNLPGGGVQRGNVLNLNGAGDPLTPGYPANEYAYRHEFTEAVGLPSIPVHPIGYDDAQKLLEHMGGSAPPDSSWKGGLKVPYNVGPGFAGNFSKQKVKLHIHSYNKVTRIYNVIGTLKGAVEPDRYVILGGHRDAWVFGGIDPQSGAAVVHEIVRTFGTLKKKGWRPRRTILFASWDAEEFGLLGSTEWAEEHSRLLQERGVAYINADSSIEGNYTLRVDCTPLMHSLVYNLTKELPSPDEGFEGKSLYDSWKEKSPSTEFIGMPRISKLGSGNDFEVFFQRLGIASGRARYTKNWKNNKVSSYPLYHSVYETYELVEKFYDPTFKYHLTVAQVRGAMVFELANSIVLPFDCQSYAVALKKHAETIYNISMNHPQEMKAYMISFDSLFSAVNNFTDVASKFNQRLQDLDKSNPILLRILNDQLMYLERAFIDPLGLPGRPFYRHIIYAPSSHNKYAGESFPGIYDALFDINNKVDTSKAWREVKRQISIAAFTVQAAAETLREVDSGDYKDDDDK

SEQ ID NO: 207 - DNA, 2283 bp, Artificial Sequence
  mutated human PSMA antigen
atgtggaatctcctgcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaaaacatcattatttgaaccaccccctccaggatatgaaaatgtttcggatattgtaccacctttcagtgctttctctcctcaaggaacaccagagggcgatctagtgtatgttaactatgcacgaactgaagacttctttaaattggaacgggtcatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaacatatgggtggctcagcaccaccagatagcagctggagaggaagtctcaaagtgccctacaatgttggacctggctttgctggaaacttttctaaacaaaaagtcaagctgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgtccatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgcagactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaaggcgtacatggtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattaataacaaagtggacacttccaaggcctggggagaagtgaagagacagatttatgttgcagccttcacagtgcaggcagctgcagagactttgagtgaagtggcctccggggattacaaggacgacgatgacaagtaa

SEQ ID NO: 208 - protein, 760 aa, Artificial Sequence
  mutated human PSMA antigen
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFKTSLFEPPPPGYENVSDIVPPFSAFSPQGTPEGDLVYVNYARTEDFFKLERVMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEHMGGSAPPDSSWRGSLKVPYNVGPGFAGNFSKQKVKLHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKAYMVSFDSLFSAVKNFTEIASKFSERLQDFDKSNPIVLRMMNDQLMFLERAFIDPLGLPDRPFYRHVIYAPSSHNKYAGESFPGIYDALFDINNKVDTSKAWGEVKRQIYVAAFTVQAAAETLSEVASGDYKDDDDK

SEQ ID NO: 209 - DNA, 2289 bp, Artificial Sequence
  mutated rat PSMA antigen
atgtggaacgctcagcaggacagcgactccgcggaggccctgggacgccgccaacgctggttctgtgctggaacactggtgctggctttcactggaaccttcatcattggcttcctctttgggtggtttataaaaccctccaatgattctactagcagtgtttcctatcctggcatgaagaaggcatttttgcaagaattgaaggctgagaacatcaaaaaatttttatacaatttcacacggacaccacatttggcagggacacaacacaattttgagcttgcaaagcaaattcatgcccagtggaaagaatttggcctggatttggttgagttatctgattatgatgtcctgttgtcctacccaaataagacccatcccaactatatctcaataattaatgaagatggaaatgagattttcaacacatcattagctgaactgtcacccccgggatatgagaacatatcagatgtagtgccaccatacagtgccttctctccacaagggatgccagagggggatctagtatatgttaactatgcacgaactgaagacttctttaaactggaacgggacatgaagatcaattgttctgggaagattgtcatcgccagatatgggcaagtgttcagaggaaataaggttaaaaatgctcagctggcaggtgcaaaaggaatcattctgtactcagaccctgctgattactttgttcctggggtgaagtcctatccagatggttggaacctccctggaggtggtgttcagcgtggaaatgtcttaaatcttaatggtgcaggtgatcccctcacaccaggttatccagcaaatgaatatgcctacaggcatgagttcacagaagctgtcggtcttccaagtattcctgtccatccaattggatatgatgatgcacagaaactattagaaaaaatgggtggctccgcaccccctgacagcagctggaagggaggactaaaagtgccttacaacgtgggacctggctttactggaaacttttcaacacaaaaggtcaagatgcatattcactcctacaataaagtgacaagaatctacaatgttattggtaccctcaaaggagctgtggaaccagacagatatgttattcttggagggcacagagatgcttgggtgtttggtggcattgaccctcagagtggagcagctgttgttcatgaaattgtcaggacctttggaactctgaagaagaaaggttggaggcctagaagaactattttgtttgcaagctgggatgctgaagaatttggccttcttggttctactgagtgggcagaggaacattcaagactcttacaagaacgtggtgtggcttatatcaacgctgattcttccatagaaggaaactacactctcagagttgattgcacaccactgatgcacagcttagtatacaacctaacaaaagagctgccaagcccggatgaaggctttgaaggcaaatctctttatgacagctggaaagaaaaaagtccttcaactgagttcattggaatgccaaggattagcaagctggggtctggcaatgattttgaagtgtttttccaaagacttggaattgcttcaggcagagcccggtatactaaaaattggaaaaacaacaaagtcagcagctatcctctctatcacagtgtctatgaaacatacgaattggtagaaaaattctatgatccgacatttaaatatcacctcactgtggcccaggttcgaggagcaatggtatttgaattggccaattctatagtgcttccctttgactgccaaagttatgctgtagctctgaagaaacatgctgagactatctacaacatttcaatgaatcatccacaggagatgaagacatacagtatatcatttgattcgctgttttctgcagtaaataattttacagatgttgcatccaagttcaatcagagactgcaagacttagacaagagcaaccccatattactgagaattttgaatgatcagctaatgtatctggaacgtgcattcattgatcctttaggattaccaggaaggcctttctacaggcatatcatctatgctccaagcagccacaacaagtatgcaggagaatcattcccagggatttatgatgccctttttgatattgaaagcaaagtcgatccttctaaggcctggagagaagtgaagagacagatttctattgcagccttcacagtgcaagctgcagcagagactctgagagaagtagactccggggattacaaggacgacgatgacaagtaa

SEQ ID NO: 210 - protein, 762 aa, Artificial Sequence
  mutated rat PSMA antigen
MWNAQQDSDSAEALGRRQRWFCAGTLVLAFTGTFIIGFLFGWFIKPSNDSTSSVSYPGMKKAFLQELKAENIKKFLYNFTRTPHLAGTQHNFELAKQIHAQWKEFGLDLVELSDYDVLLSYPNKTHPNYISIINEDGNEIFNTSLAELSPPGYENISDVVPPYSAFSPQGMPEGDLVYVNYARTEDFFKLERDMKINCSGKIVIARYGQVFRGNKVKNAQLAGAKGIILYSDPADYFVPGVKSYPDGWNLPGGGVQRGNVLNLNGAGDPLTPGYPANEYAYRHEFTEAVGLPSIPVHPIGYDDAQKLLEKMGGSAPPDSSWKGGLKVPYNVGPGFTGNFSTQKVKMHIHSYNKVTRIYNVIGTLKGAVEPDRYVILGGHRDAWVFGGIDPQSGAAVVHEIVRTFGTLKKKGWRPRRTILFASWDAEEFGLLGSTEWAEEHSRLLQERGVAYINADSSIEGNYTLRVDCTPLMHSLVYNLTKELPSPDEGFEGKSLYDSWKEKSPSTEFIGMPRISKLGSGNDFEVFFQRLGIASGRARYTKNWKNNKVSSYPLYHSVYETYELVEKFYDPTFKYHLTVAQVRGAMVFELANSIVLPFDCQSYAVALKKHAETIYNISMNHPQEMKTYSISFDSLFSAVNNFTDVASKFNQRLQDLDKSNPILLRILNDQLMYLERAFIDPLGLPGRPFYRHIIYAPSSHNKYAGESFPGIYDALFDIESKVDPSKAWREVKRQISIAAFTVQAAAETLREVDSGDYKDDDDK

SEQ ID NO: 211 - DNA, 28 bp, Artificial Sequence
  5'-VH-family specific primer MVH1
gcaggtgcagctcgaggagtcaggacct

SEQ ID NO: 212 - DNA, 27 bp, Artificial Sequence
  5'-VH-family specific primer MVH2
gaggtccagctcgagcagtctggacct

SEQ ID NO: 213 - DNA, 27 bp, Artificial Sequence
  5'-VH-family specific primer MVH3
caggtccaactcgagcagcctggggct

SEQ ID NO: 214 - DNA, 27 bp, Artificial Sequence
  5'-VH-family specific primer MVH4
gaggttcagctcgagcagtctggggca

SEQ ID NO: 215 - DNA, 28 bp, Artificial Sequence
  5'-VH-family specific primer MVH5
gaaggtgaagctcgaggagtctggagga

SEQ ID NO: 216 - DNA, 27 bp, Artificial Sequence
  5'-VH-family specific primer MVH6
gaggtgaagcttctcgagtctggaggt

SEQ ID NO: 217 - DNA, 27 bp, Artificial Sequence
  5'-VH-family specific primer MVH7
gaagtgaagctcgaggagtctggggga

SEQ ID NO: 218 - DNA, 27 bp, Artificial Sequence
  5'-vh-family specific primer mvh8
gaggttcagctcgagcagtctggagct

SEQ ID NO: 219 - DNA, 34 bp, Artificial Sequence
  3'-VH primer 3'MuVHBstEII
tgaggagacggtgaccgtggtcccttggccccag

SEQ ID NO: 220 - DNA, 32 bp, Artificial Sequence
  5'-VK-family specific primer MUVK1
ccagttccgagctcgttgtgactcaggaatct

SEQ ID NO: 221 - DNA, 32 bp, Artificial Sequence
  5'-VK-family specific primer MUVK2
ccagttccgagctcgtgttgacgcagccgccc

SEQ ID NO: 222 - DNA, 32 bp, Artificial Sequence
  5'-VK-family specific primer MUVK3
ccagttccgagctcgtgctcacccagtctcca

SEQ ID NO: 223 - DNA, 32 bp, Artificial Sequence
  5'-VK-family specific primer MUVK4
ccagttccgagctccagatgacccagtctcca

SEQ ID NO: 224 - DNA, 32 bp, Artificial Sequence
  5'-VK-family specific primer MUVK5
ccagatgtgagctcgtgatgacccagactcca

SEQ ID NO: 225 - DNA, 32 bp, Artificial Sequence
  5'-VK-family specific primer MUVK6
ccagatgtgagctcgtcatgacccagtctcca

SEQ ID NO: 226 - DNA, 32 bp, Artificial Sequence
  5'-VK-family specific primer MUVK7
ccagttccgagctcgtgatgacacagtctcca

SEQ ID NO: 227 - DNA, 39 bp, Artificial Sequence
  3'-VK primer 3'MuVkHindIII/BsiW1
tggtgcactagtcgtacgtttgatctcaagcttggtccc

SEQ ID NO: 228 - DNA, 21 bp, Artificial Sequence
  macaque PSMA forward primer
cactgtggcccaggttcgagg

SEQ ID NO: 229 - DNA, 25 bp, Artificial Sequence
  macaque PSMA reverse primer
gacataccacacaaattcaatacgg

SEQ ID NO: 230 - DNA, 23 bp, Artificial Sequence
  macaque PSMA forward primer
gctctgctcgcgccgagatgtgg

SEQ ID NO: 231 - DNA, 21 bp, Artificial Sequence
  macaque PSMA reverse primer
acgctggacaccacctccagg

SEQ ID NO: 232 - DNA, 22 bp, Artificial Sequence
  macaque PSMA forward primer
ggttctactgagtgggcagagg

SEQ ID NO: 233 - DNA, 22 bp, Artificial Sequence
  macaque PSMA reverse primer
acttgttgtggctgcttggagc

SEQ ID NO: 234 - DNA, 22 bp, Artificial Sequence
  macaque PSMA forward primer
gggtgaagtcctatccagatgg

SEQ ID NO: 235 - DNA, 22 bp, Artificial Sequence
  macaque PSMA reverse primer
gtgctctgcctgaagcaattcc

SEQ ID NO: 236 - DNA, 21 bp, Artificial Sequence
  macaque PSMA forward primer
ctcggcttcctcttcgggtgg

SEQ ID NO: 237 - DNA, 26 bp, Artificial Sequence
  macaque PSMA reverse primer
gcatattcatttgctgggtaacctgg

SEQ ID NO: 238 - DNA, 2253 bp, Artificial Sequence
  macaque PSMA
atgtggaatctcctgcacgaaaccgactcggctgtggccaccgcgcgccgcccgcgctggctgtgcgctggggcactggtgctggcgggtggcttctttctcctcggcttcctcttcggatggtttataaaatcctccagtgaagctactaacattactccaaagcataatatgaaagcatttttggatgaactgaaagctgagaacatcaagaagttcttacataattttacacagataccacatttagcaggaacagaacaaaactttcaacttgcaaagcaaattcaatcccagtggaaagaatttggcctggattctgttgagctaactcattatgatgtcctgttgtcctacccaaataagactcatcccaactacatctcaataattaatgaagatggaaatgagattttcaacacatcattatttgaaccacctcctgcaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccacaggagtcattctctactcagaccctgctgactactttgctcctggggtaaagtcttatccagatggttggaatcttcctggaggtggtgtccagcgtggaaatatcctaaatctgaatggtgcaggagaccctctcacaccaggttacccagcaaatgaatatgcttataggcgtggaatggcagaggctgttggtcttccaagtattcccgttcatccaattgggtactatgatgcacagaagctcctagaaaaaatgggtggctcagcatcaccagatagcagctggagaggaagtctcaaagtgccctacaatgttggacctggctttactggaaacttttctacacaaaaagtcaagatgcacatccactctaccagtgaagtgacaagaatttacaatgtgataggtactctcagaggagcagtggaaccagacagatacgtcattctgggaggtcaccgggactcatgggtgtttggtggtattgaccctcagagtggagcagctgttgttcatgaaattgtgaggagctttggaacgctgaaaaaggaagggtggagacctagaagaacaattttgtttgcaagctgggatgcagaagaatttggtcttcttggttctactgaatgggcagaggagaattcaagactccttcaagagcgtggcgtggcttatattaatgctgattcgtctatagagggaaactacactctgagagttgattgtacaccactgatgtacagcttggtatacaacctaacaaaagagctggaaagccctgatgaaggctttgaaggcaaatctctttatgaaagttggactaaaaaaagtccttcccccgagttcagtggcatgcccaggataagcaaattgggatctggaaatgattttgaggtgttcttccaacgacttggaattgcctcaggcagagcacggtatactaaaaattgggaaacaaacaaattcagcagctatccactgtatcacagtgtctatgagacatatgagttggtggaaaagttttatgatccaatgtttaaatatcacctcactgtggcccaggttcgaggagggatggtgtttgaactagccaattccgtagtgctcccttttgattgtcgagattatgctgtagttttaagaaagtatgctgacaaaatctacaatatttctatgaaacatccacaggaaatgaagacatacagtgtatcatttgattcacttttttctgcagtaaagaattttacagaaattgcttccaagttcagcgagagactccgggactttgacaaaagcaacccaatattattaagaatgatgaatgatcaactcatgtttctggaaagagcatttattgatccattagggttaccagacagacctttttataggcatgtcatctatgctccaagcagccacaacaagtatgcaggggagtcattcccaggaatttatgatgctctgtttgatatcgaaagcaaagtggacccttcccaggcctggggagaagtgaagagacagatttctgttgcaaccttcacagtgcaagcagctgcagagactttgagtgaagtggcctaa

SEQ ID NO: 239 - protein, 750 aa, Artificial Sequence
  macaque PSMA
MWNLLHETDSAVATARRPRWLCAGALVLAGGFFLLGFLFGWFIKSSSEATNITPKHNMKAFLDELKAENIKKFLHNFTQIPHLAGTEQNFQLAKQIQSQWKEFGLDSVELTHYDVLLSYPNKTHPNYISIINEDGNEIFNTSLFEPPPAGYENVSDIVPPFSAFSPQGMPEGDLVYVNYARTEDFFKLERDMKINCSGKIVIARYGKVFRGNKVKNAQLAGATGVILYSDPADYFAPGVKSYPDGWNLPGGGVQRGNILNLNGAGDPLTPGYPANEYAYRRGMAEAVGLPSIPVHPIGYYDAQKLLEKMGGSASPDSSWRGSLKVPYNVGPGFTGNFSTQKVKMHIHSTSEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVYNLTKELESPDEGFEGKSLYESWTKKSPSPEFSGMPRISKLGSGNDFEVFFQRLGIASGRARYTKNWETNKFSSYPLYHSVYETYELVEKFYDPMFKYHLTVAQVRGGMVFELANSVVLPFDCRDYAVVLRKYADKIYNISMKHPQEMKTYSVSFDSLFSAVKNFTEIASKFSERLRDFDKSNPILLRMMNDQLMFLERAFIDPLGLPDRPFYRHVIYAPSSHNKYAGESFPGIYDALFDIESKVDPSQAWGEVKRQISVATFTVQAAAETLSEVA

SEQ ID NO: 240 - protein, 107 aa, Artificial Sequence
  PSMA D3 L
DIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLK

SEQ ID NO: 241 - protein, 11 aa, Artificial Sequence
  PSMA D3 LCDR1
KASQDVGTAVD

SEQ ID NO: 242 - protein, 7 aa, Artificial Sequence
  PSMA D3 LCDR2
WASTRHT

SEQ ID NO: 243 - protein, 9 aa, Artificial Sequence
  PSMA D3 LCDR3
QQYNSYPLT

SEQ ID NO: 244 - DNA, 321 bp, Artificial Sequence
  PSMA D3 VL
gacatcgtgatgacccagtcccacaagttcatgtccacctccgtgggcgaccgggtgtccatcatctgcaaggcctcccaggatgtgggcaccgccgtggactggtatcagcagaagcctggccagtcccctaagctgctgatctactgggcctccaccagacacaccggcgtgcctgacagattcaccggctccggctctggcaccgacttcaccctgaccatcaccaacgtgcagtccgaggacctggccgactacttctgccagcagtacaactcctaccctctgaccttcggcgctggcaccatgctggacctgaag

SEQ ID NO: 245 - protein, 115 aa, Artificial Sequence
  PSMA D3 H
EVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTLTVSS

SEQ ID NO: 246 - protein, 5 aa, Artificial Sequence
  PSMA D3 HCDR1
EYTIH

SEQ ID NO: 247 - protein, 17 aa, Artificial Sequence
  PSMA D3 HCDR2
NINPNNGGTTYNQKFED

SEQ ID NO: 248 - protein, 6 aa, Artificial Sequence
  PSMA D3 HCDR3
GWNFDY

SEQ ID NO: 249 - DNA, 345 bp, Artificial Sequence
  PSMA D3 H
gaagtgcagctgcagcagtccggccctgagctggtgaagcctggcacctccgtgcggatctcttgcaagacctccggctacaccttcaccgagtacaccatccactgggtgaaacagtcccacggcaagtccctggaatggatcggcaacatcaaccctaacaacggcggcaccacctacaaccagaagttcgaggacaaggccaccctgaccgtggacaagtcctcctccaccgcctacatggaactgcggtccctgacctccgaggactccgccgtgtactactgcgccgctggctggaacttcgactactggggccagggcaccacactgaccgtgtcctcc

SEQ ID NO: 250 - protein, 237 aa, Artificial Sequence
  PSMA D3 LH
DIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKGGGGSGGGGSGGGGSEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTLTVSS

SEQ ID NO: 251 - DNA, 711 bp, Artificial Sequence
  PSMA D3 LH
gacatcgtgatgacccagtcccacaagttcatgtccacctccgtgggcgaccgggtgtccatcatctgcaaggcctcccaggatgtgggcaccgccgtggactggtatcagcagaagcctggccagtcccctaagctgctgatctactgggcctccaccagacacaccggcgtgcctgacagattcaccggctccggctctggcaccgacttcaccctgaccatcaccaacgtgcagtccgaggacctggccgactacttctgccagcagtacaactcctaccctctgaccttcggcgctggcaccatgctggacctgaagggcggagggggctctggcggcggaggaagtggagggggcggatccgaagtgcagctgcagcagtccggccctgagctggtgaagcctggcacctccgtgcggatctcttgcaagacctccggctacaccttcaccgagtacaccatccactgggtgaaacagtcccacggcaagtccctggaatggatcggcaacatcaaccctaacaacggcggcaccacctacaaccagaagttcgaggacaaggccaccctgaccgtggacaagtcctcctccaccgcctacatggaactgcggtccctgacctccgaggactccgccgtgtactactgcgccgctggctggaacttcgactactggggccagggcaccacactgaccgtgtcctcc

SEQ ID NO: 252 - protein, 491 aa, Artificial Sequence
  PSMA D3  LH x I2C HL
DIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKGGGGSGGGGSGGGGSEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTLTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 253 - DNA, 1473 bp, Artificial Sequence
  PSMA D3  LH x I2C HL
gacatcgtgatgacccagtcccacaagttcatgtccacctccgtgggcgaccgggtgtccatcatctgcaaggcctcccaggatgtgggcaccgccgtggactggtatcagcagaagcctggccagtcccctaagctgctgatctactgggcctccaccagacacaccggcgtgcctgacagattcaccggctccggctctggcaccgacttcaccctgaccatcaccaacgtgcagtccgaggacctggccgactacttctgccagcagtacaactcctaccctctgaccttcggcgctggcaccatgctggacctgaagggcggagggggctctggcggcggaggaagtggagggggcggatccgaagtgcagctgcagcagtccggccctgagctggtgaagcctggcacctccgtgcggatctcttgcaagacctccggctacaccttcaccgagtacaccatccactgggtgaaacagtcccacggcaagtccctggaatggatcggcaacatcaaccctaacaacggcggcaccacctacaaccagaagttcgaggacaaggccaccctgaccgtggacaagtcctcctccaccgcctacatggaactgcggtccctgacctccgaggactccgccgtgtactactgcgccgctggctggaacttcgactactggggccagggcaccacactgaccgtgtcctccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 254 - protein, 111 aa, Artificial Sequence
  PSMA P6 L
DIVLTQSPASLAVSLGQRATISCRASESIDSYDNTFMHWYQQKPGQPPNLLIFRASILESGIPARFSGSGSGTDFTLTIYPVEADDVATYYCHQSIEDPYTFGGGTKLEIK

SEQ ID NO: 255 - protein, 15 aa, Artificial Sequence
  PSMA P6 LCDR1
RASESIDSYDNTFMH

SEQ ID NO: 256 - protein, 7 aa, Artificial Sequence
  PSMA P6 LCDR2
RASILES

SEQ ID NO: 257 - protein, 9 aa, Artificial Sequence
  PSMA P6 LCDR3
HQSIEDPYT

SEQ ID NO: 258 - DNA, 333 bp, Artificial Sequence
  PSMA P6 VL
gacatcgtgctgacccagtctccagcctccctggctgtgtctctgggccagcgggccaccatctcttgccgggcctccgagtccatcgactcctacgacaacaccttcatgcactggtatcagcagaagcctggccagcctcctaacctgctgatcttccgggcctctatcctggaatccggcatccctgcccggttctccggctctggctccggcaccgacttcaccctgaccatctaccctgtggaggccgacgacgtggccacctactactgccaccagtccatcgaggacccttacaccttcggcggagggaccaagctggaaatcaag

SEQ ID NO: 259 - protein, 118 aa, Artificial Sequence
  PSMA P6 H
EVQLQQSGPELVKPGASVKMSCKASGYTFTGYVMHWVKQKPGQVLEWIGYINPYNDVTRYNGKFKGKATLTSDKYSSTAYMELSGLTSEDSAVYYCARGENWYYFDSWGRGATLTVSS

SEQ ID NO: 260 - protein, 5 aa, Artificial Sequence
  PSMA P6 HCDR1
GYVMH

SEQ ID NO: 261 - protein, 17 aa, Artificial Sequence
  PSMA P6 HCDR2
YINPYNDVTRYNGKFKG

SEQ ID NO: 262 - protein, 9 aa, Artificial Sequence
  PSMA P6 HCDR3
GENWYYFDS

SEQ ID NO: 263 - DNA, 354 bp, Artificial Sequence
  PSMA P6 H
gaagtgcagctgcagcagtccggccctgagctggtgaagcctggcgcctccgtgaagatgtcctgcaaggcctccggctacaccttcaccggctacgtgatgcactgggtgaaacagaaacccggccaggtgctggaatggatcggctacatcaacccttacaacgacgtgacccggtacaacggcaagttcaagggcaaggccaccctgacctccgacaagtactcctccaccgcctacatggaactgtccggcctgacctctgaggactccgccgtgtactactgcgccaggggcgagaactggtactacttcgactcctggggcagaggcgctaccctgaccgtgtcttcc

SEQ ID NO: 264 - protein, 244 aa, Artificial Sequence
  PSMA P6 LH
DIVLTQSPASLAVSLGQRATISCRASESIDSYDNTFMHWYQQKPGQPPNLLIFRASILESGIPARFSGSGSGTDFTLTIYPVEADDVATYYCHQSIEDPYTFGGGTKLEIKGGGGSGGGGSGGGGSEVQLQQSGPELVKPGASVKMSCKASGYTFTGYVMHWVKQKPGQVLEWIGYINPYNDVTRYNGKFKGKATLTSDKYSSTAYMELSGLTSEDSAVYYCARGENWYYFDSWGRGATLTVSS

SEQ ID NO: 265 - DNA, 732 bp, Artificial Sequence
  PSMA P6 LH
gacatcgtgctgacccagtctccagcctccctggctgtgtctctgggccagcgggccaccatctcttgccgggcctccgagtccatcgactcctacgacaacaccttcatgcactggtatcagcagaagcctggccagcctcctaacctgctgatcttccgggcctctatcctggaatccggcatccctgcccggttctccggctctggctccggcaccgacttcaccctgaccatctaccctgtggaggccgacgacgtggccacctactactgccaccagtccatcgaggacccttacaccttcggcggagggaccaagctggaaatcaagggcggagggggatctggcggcggaggaagtggagggggcggatccgaagtgcagctgcagcagtccggccctgagctggtgaagcctggcgcctccgtgaagatgtcctgcaaggcctccggctacaccttcaccggctacgtgatgcactgggtgaaacagaaacccggccaggtgctggaatggatcggctacatcaacccttacaacgacgtgacccggtacaacggcaagttcaagggcaaggccaccctgacctccgacaagtactcctccaccgcctacatggaactgtccggcctgacctctgaggactccgccgtgtactactgcgccaggggcgagaactggtactacttcgactcctggggcagaggcgctaccctgaccgtgtcttcc

SEQ ID NO: 266 - protein, 498 aa, Artificial Sequence
  PSMA P6  LH x I2C HL
DIVLTQSPASLAVSLGQRATISCRASESIDSYDNTFMHWYQQKPGQPPNLLIFRASILESGIPARFSGSGSGTDFTLTIYPVEADDVATYYCHQSIEDPYTFGGGTKLEIKGGGGSGGGGSGGGGSEVQLQQSGPELVKPGASVKMSCKASGYTFTGYVMHWVKQKPGQVLEWIGYINPYNDVTRYNGKFKGKATLTSDKYSSTAYMELSGLTSEDSAVYYCARGENWYYFDSWGRGATLTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 267 - DNA, 1494 bp, Artificial Sequence
  PSMA P6  LH x I2C HL
gacatcgtgctgacccagtctccagcctccctggctgtgtctctgggccagcgggccaccatctcttgccgggcctccgagtccatcgactcctacgacaacaccttcatgcactggtatcagcagaagcctggccagcctcctaacctgctgatcttccgggcctctatcctggaatccggcatccctgcccggttctccggctctggctccggcaccgacttcaccctgaccatctaccctgtggaggccgacgacgtggccacctactactgccaccagtccatcgaggacccttacaccttcggcggagggaccaagctggaaatcaagggcggagggggatctggcggcggaggaagtggagggggcggatccgaagtgcagctgcagcagtccggccctgagctggtgaagcctggcgcctccgtgaagatgtcctgcaaggcctccggctacaccttcaccggctacgtgatgcactgggtgaaacagaaacccggccaggtgctggaatggatcggctacatcaacccttacaacgacgtgacccggtacaacggcaagttcaagggcaaggccaccctgacctccgacaagtactcctccaccgcctacatggaactgtccggcctgacctctgaggactccgccgtgtactactgcgccaggggcgagaactggtactacttcgactcctggggcagaggcgctaccctgaccgtgtcttccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 268 - protein, 107 aa, Artificial Sequence
  PSMA P1 L
DIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIK

SEQ ID NO: 269 - protein, 11 aa, Artificial Sequence
  PSMA P1 LCDR1
RASQGISNYLA

SEQ ID NO: 270 - protein, 7 aa, Artificial Sequence
  PSMA P1 LCDR2
EASTLQS

SEQ ID NO: 271 - protein, 9 aa, Artificial Sequence
  PSMA P1 LCDR3
QNYNSAPFT

SEQ ID NO: 272 - DNA, 321 bp, Artificial Sequence
  PSMA P1 VL
gacatccagatgacccagtccccctcctccctgtctgcctccgtgggcgacagagtgaccatcacctgccgggcctcccagggcatctccaactacctggcctggtatcagcagaaaaccggcaaggtgcccaagttcctgatctacgaggcctccaccctgcagtccggcgtgccttccagattctctggcggcggatccggcaccgacttcaccctgaccatctccagcctgcagcctgaggacgtggccacctactactgccagaactacaactccgcccctttcaccttcggccctggcaccaaggtggacatcaag

SEQ ID NO: 273 - protein, 123 aa, Artificial Sequence
  PSMA P1 H
QVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSS

SEQ ID NO: 274 - protein, 5 aa, Artificial Sequence
  PSMA P1 HCDR1
RYGMH

SEQ ID NO: 275 - protein, 17 aa, Artificial Sequence
  PSMA P1 HCDR2
VIWYDGSNKYYADSVKG

SEQ ID NO: 276 - protein, 14 aa, Artificial Sequence
  PSMA P1 HCDR3
GGDFLYYYYYGMDV

SEQ ID NO: 277 - DNA, 369 bp, Artificial Sequence
  PSMA P1 H
caggtgcagctggtcgagtctggcggaggggtggtccagcctggccggtccctgagactgtcttgcgccgcctccggcttcgccttctccagatacggcatgcactgggtgcgccaggctccaggcaagggactggaatgggtggccgtgatttggtacgacggctccaacaagtactacgccgactccgtgaagggccggttcaccatctcccgggacaactccaagaacacccagtacctgcagatgaactccctgagggcagaggacaccgccgtgtactactgcgccagaggcggcgacttcctgtactactactattacggcatggacgtgtggggccagggcaccaccgtgacagtgtcttcc

SEQ ID NO: 278 - protein, 245 aa, Artificial Sequence
  PSMA P1 LH
DIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSS

SEQ ID NO: 279 - DNA, 735 bp, Artificial Sequence
  PSMA P1 LH
gacatccagatgacccagtccccctcctccctgtctgcctccgtgggcgacagagtgaccatcacctgccgggcctcccagggcatctccaactacctggcctggtatcagcagaaaaccggcaaggtgcccaagttcctgatctacgaggcctccaccctgcagtccggcgtgccttccagattctctggcggcggatccggcaccgacttcaccctgaccatctccagcctgcagcctgaggacgtggccacctactactgccagaactacaactccgcccctttcaccttcggccctggcaccaaggtggacatcaagggcggagggggcagtggcggcggaggaagtggagggggcggatctcaggtgcagctggtcgagtctggcggaggggtggtccagcctggccggtccctgagactgtcttgcgccgcctccggcttcgccttctccagatacggcatgcactgggtgcgccaggctccaggcaagggactggaatgggtggccgtgatttggtacgacggctccaacaagtactacgccgactccgtgaagggccggttcaccatctcccgggacaactccaagaacacccagtacctgcagatgaactccctgagggcagaggacaccgccgtgtactactgcgccagaggcggcgacttcctgtactactactattacggcatggacgtgtggggccagggcaccaccgtgacagtgtcttcc

SEQ ID NO: 280 - protein, 499 aa, Artificial Sequence
  PSMA P1  LH x I2C HL
DIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 281 - DNA, 1497 bp, Artificial Sequence
  PSMA P1  LH x I2C HL
gacatccagatgacccagtccccctcctccctgtctgcctccgtgggcgacagagtgaccatcacctgccgggcctcccagggcatctccaactacctggcctggtatcagcagaaaaccggcaaggtgcccaagttcctgatctacgaggcctccaccctgcagtccggcgtgccttccagattctctggcggcggatccggcaccgacttcaccctgaccatctccagcctgcagcctgaggacgtggccacctactactgccagaactacaactccgcccctttcaccttcggccctggcaccaaggtggacatcaagggcggagggggcagtggcggcggaggaagtggagggggcggatctcaggtgcagctggtcgagtctggcggaggggtggtccagcctggccggtccctgagactgtcttgcgccgcctccggcttcgccttctccagatacggcatgcactgggtgcgccaggctccaggcaagggactggaatgggtggccgtgatttggtacgacggctccaacaagtactacgccgactccgtgaagggccggttcaccatctcccgggacaactccaagaacacccagtacctgcagatgaactccctgagggcagaggacaccgccgtgtactactgcgccagaggcggcgacttcctgtactactactattacggcatggacgtgtggggccagggcaccaccgtgacagtgtcttccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 282 - protein, 107 aa, Artificial Sequence
  PSMA P2 L
DIQMTQSPSSLSASVGDRVTITCRASQGITNYLAWFQQKPGKAPKSLIYAASSLQSGVPSKFSGSGSGTDFSLTISSLQPEDFATYYCQQYNSYPITFGQGTRLEIK

SEQ ID NO: 283 - protein, 11 aa, Artificial Sequence
  PSMA P2 LCDR1
RASQGITNYLA

SEQ ID NO: 284 - protein, 7 aa, Artificial Sequence
  PSMA P2 LCDR2
AASSLQS

SEQ ID NO: 285 - protein, 9 aa, Artificial Sequence
  PSMA P2 LCDR3
QQYNSYPIT

SEQ ID NO: 286 - DNA, 321 bp, Artificial Sequence
  PSMA P2 VL
gacatccagatgacccagtcaccctcctccctgtctgcctccgtgggcgacagagtgaccatcacctgccgggcctcacagggcatcaccaactacctggcctggttccagcagaagcctggcaaggcccctaagtccctgatctacgccgcctcctctctgcagtccggcgtgccttccaagttctccggctccggctctggcaccgacttctccctgaccatctcctccctgcagcctgaggacttcgccacctactactgccagcagtacaactcctaccctatcaccttcggccagggcacccggctggaaatcaag

SEQ ID NO: 287 - protein, 124 aa, Artificial Sequence
  PSMA P2 H
QVQLVESGGGVVQPGRSLRLSCAASGFTFSNYVMHWVRQAPGKGLEWVAIIWYDGSNKYYADSVKGRFTISRDNSKNTLYLQMNSLRAEDTAVYYCAGGYNWNYEYHYYGMDVWGQGTTVTVSS

SEQ ID NO: 288 - protein, 5 aa, Artificial Sequence
  PSMA P2 HCDR1
NYVMH

SEQ ID NO: 289 - protein, 17 aa, Artificial Sequence
  PSMA P2 HCDR2
IIWYDGSNKYYADSVKG

SEQ ID NO: 290 - protein, 15 aa, Artificial Sequence
  PSMA P2 HCDR3
GYNWNYEYHYYGMDV

SEQ ID NO: 291 - DNA, 372 bp, Artificial Sequence
  PSMA P2 H
caggtgcagctggtcgagtctggcggaggggtggtgcagcctggccggtccctgagactgtcttgcgctgcctccggcttcaccttctccaactacgtgatgcactgggtgcgccaggctccaggcaagggactggaatgggtggccatcatttggtacgacggctccaacaagtactacgccgactccgtgaagggccggttcaccatctcccgggacaactccaagaacaccctgtacctgcagatgaactccctgagggccgaggacaccgccgtgtactactgcgctggcggctacaactggaactacgagtaccactactacggcatggacgtgtggggccagggaaccaccgtgaccgtgtcttcc

SEQ ID NO: 292 - protein, 246 aa, Artificial Sequence
  PSMA P2 LH
DIQMTQSPSSLSASVGDRVTITCRASQGITNYLAWFQQKPGKAPKSLIYAASSLQSGVPSKFSGSGSGTDFSLTISSLQPEDFATYYCQQYNSYPITFGQGTRLEIKGGGGSGGGGSGGGGSQVQLVESGGGVVQPGRSLRLSCAASGFTFSNYVMHWVRQAPGKGLEWVAIIWYDGSNKYYADSVKGRFTISRDNSKNTLYLQMNSLRAEDTAVYYCAGGYNWNYEYHYYGMDVWGQGTTVTVSS

SEQ ID NO: 293 - DNA, 738 bp, Artificial Sequence
  PSMA P2 LH
gacatccagatgacccagtcaccctcctccctgtctgcctccgtgggcgacagagtgaccatcacctgccgggcctcacagggcatcaccaactacctggcctggttccagcagaagcctggcaaggcccctaagtccctgatctacgccgcctcctctctgcagtccggcgtgccttccaagttctccggctccggctctggcaccgacttctccctgaccatctcctccctgcagcctgaggacttcgccacctactactgccagcagtacaactcctaccctatcaccttcggccagggcacccggctggaaatcaagggcggagggggatctggcggcggaggaagtggagggggcggatctcaggtgcagctggtcgagtctggcggaggggtggtgcagcctggccggtccctgagactgtcttgcgctgcctccggcttcaccttctccaactacgtgatgcactgggtgcgccaggctccaggcaagggactggaatgggtggccatcatttggtacgacggctccaacaagtactacgccgactccgtgaagggccggttcaccatctcccgggacaactccaagaacaccctgtacctgcagatgaactccctgagggccgaggacaccgccgtgtactactgcgctggcggctacaactggaactacgagtaccactactacggcatggacgtgtggggccagggaaccaccgtgaccgtgtcttcc

SEQ ID NO: 294 - protein, 500 aa, Artificial Sequence
  PSMA P2  LH x I2C HL
DIQMTQSPSSLSASVGDRVTITCRASQGITNYLAWFQQKPGKAPKSLIYAASSLQSGVPSKFSGSGSGTDFSLTISSLQPEDFATYYCQQYNSYPITFGQGTRLEIKGGGGSGGGGSGGGGSQVQLVESGGGVVQPGRSLRLSCAASGFTFSNYVMHWVRQAPGKGLEWVAIIWYDGSNKYYADSVKGRFTISRDNSKNTLYLQMNSLRAEDTAVYYCAGGYNWNYEYHYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 295 - DNA, 1500 bp, Artificial Sequence
  PSMA P2  LH x I2C HL
gacatccagatgacccagtcaccctcctccctgtctgcctccgtgggcgacagagtgaccatcacctgccgggcctcacagggcatcaccaactacctggcctggttccagcagaagcctggcaaggcccctaagtccctgatctacgccgcctcctctctgcagtccggcgtgccttccaagttctccggctccggctctggcaccgacttctccctgaccatctcctccctgcagcctgaggacttcgccacctactactgccagcagtacaactcctaccctatcaccttcggccagggcacccggctggaaatcaagggcggagggggatctggcggcggaggaagtggagggggcggatctcaggtgcagctggtcgagtctggcggaggggtggtgcagcctggccggtccctgagactgtcttgcgctgcctccggcttcaccttctccaactacgtgatgcactgggtgcgccaggctccaggcaagggactggaatgggtggccatcatttggtacgacggctccaacaagtactacgccgactccgtgaagggccggttcaccatctcccgggacaactccaagaacaccctgtacctgcagatgaactccctgagggccgaggacaccgccgtgtactactgcgctggcggctacaactggaactacgagtaccactactacggcatggacgtgtggggccagggaaccaccgtgaccgtgtcttccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 296 - protein, 107 aa, Artificial Sequence
  PSMA P3 L
DIQMTQSPSSLSASVGDRVTITCRASQGISHYLAWFQQKPGKAPKSLIYAASSLQSGVPSKFSGSGSGTDFTLTISSLQPEDFATYYCQQYNSFPLTFGGGTKVEIK

SEQ ID NO: 297 - protein, 11 aa, Artificial Sequence
  PSMA P3 LCDR1
RASQGISHYLA

SEQ ID NO: 298 - protein, 7 aa, Artificial Sequence
  PSMA P3 LCDR2
AASSLQS

SEQ ID NO: 299 - protein, 9 aa, Artificial Sequence
  PSMA P3 LCDR3
QQYNSFPLT

SEQ ID NO: 300 - DNA, 321 bp, Artificial Sequence
  PSMA P3 VL
gacatccagatgacccagtctccctcctccctgtctgcctccgtgggcgacagagtgaccatcacctgccgggcctcccagggcatctctcactacctggcctggttccagcagaagcctggcaaggcccctaagtccctgatctacgccgcctcctctctgcagtccggcgtgccttccaagttctccggctccggctctggcaccgacttcaccctgaccatctccagcctgcagcctgaggacttcgccacctactactgccagcagtacaactccttccctctgaccttcggcggagggaccaaggtggagatcaag

SEQ ID NO: 301 - protein, 126 aa, Artificial Sequence
  PSMA P3 H
QVQLVESGGGVVQPGRSLRLSCAASGFTFSSYGMHWVRQAPGKGLDWVAIIWHDGSNKYYADSVKGRFTISRDNSKKTLYLQMNSLRAEDTAVYYCARAWAYDYGDYEYYFGMDVWGQGTTVTVSS

SEQ ID NO: 302 - protein, 5 aa, Artificial Sequence
  PSMA P3 HCDR1
SYGMH

SEQ ID NO: 303 - protein, 17 aa, Artificial Sequence
  PSMA P3 HCDR2
IIWHDGSNKYYADSVKG

SEQ ID NO: 304 - protein, 17 aa, Artificial Sequence
  PSMA P3 HCDR3
AWAYDYGDYEYYFGMDV

SEQ ID NO: 305 - protein, 378 aa, Artificial Sequence
  PSMA P3 H
CAGGTGCAGCTGGTCGAGTCTGGCGGAGGGGTGGTGCAGCCTGGCCGGTCCCTGAGACTGTCTTGTGCCGCCTCCGGCTTCACCTTCTCCTCTTACGGCATGCACTGGGTGCGCCAGGCTCCAGGCAAGGGACTGGACTGGGTGGCCATCATCTGGCACGACGGCTCCAACAAGTACTACGCCGACTCCGTGAAGGGCCGGTTCACCATCTCCCGGGACAACTCCAAGAAAACCCTGTACCTGCAGATGAACTCCCTGAGGGCCGAGGACACCGCCGTGTACTACTGTGCCAGGGCCTGGGCCTACGACTACGGCGACTACGAGTACTACTTCGGCATGGACGTGTGGGGCCAGGGCACCACCGTGACAGTGTCTTCC

SEQ ID NO: 306 - protein, 248 aa, Artificial Sequence
  PSMA P3 LH
DIQMTQSPSSLSASVGDRVTITCRASQGISHYLAWFQQKPGKAPKSLIYAASSLQSGVPSKFSGSGSGTDFTLTISSLQPEDFATYYCQQYNSFPLTFGGGTKVEIKGGGGSGGGGSGGGGSQVQLVESGGGVVQPGRSLRLSCAASGFTFSSYGMHWVRQAPGKGLDWVAIIWHDGSNKYYADSVKGRFTISRDNSKKTLYLQMNSLRAEDTAVYYCARAWAYDYGDYEYYFGMDVWGQGTTVTVSS

SEQ ID NO: 307 - DNA, 744 bp, Artificial Sequence
  PSMA P3 LH
gacatccagatgacccagtctccctcctccctgtctgcctccgtgggcgacagagtgaccatcacctgccgggcctcccagggcatctctcactacctggcctggttccagcagaagcctggcaaggcccctaagtccctgatctacgccgcctcctctctgcagtccggcgtgccttccaagttctccggctccggctctggcaccgacttcaccctgaccatctccagcctgcagcctgaggacttcgccacctactactgccagcagtacaactccttccctctgaccttcggcggagggaccaaggtggagatcaagggcggagggggctctggcggcggaggaagtggagggggcggatctcaggtgcagctggtcgagtctggcggaggggtggtgcagcctggccggtccctgagactgtcttgtgccgcctccggcttcaccttctcctcttacggcatgcactgggtgcgccaggctccaggcaagggactggactgggtggccatcatctggcacgacggctccaacaagtactacgccgactccgtgaagggccggttcaccatctcccgggacaactccaagaaaaccctgtacctgcagatgaactccctgagggccgaggacaccgccgtgtactactgtgccagggcctgggcctacgactacggcgactacgagtactacttcggcatggacgtgtggggccagggcaccaccgtgacagtgtcttcc

SEQ ID NO: 308 - protein, 502 aa, Artificial Sequence
  PSMA P3  LH x I2C HL
DIQMTQSPSSLSASVGDRVTITCRASQGISHYLAWFQQKPGKAPKSLIYAASSLQSGVPSKFSGSGSGTDFTLTISSLQPEDFATYYCQQYNSFPLTFGGGTKVEIKGGGGSGGGGSGGGGSQVQLVESGGGVVQPGRSLRLSCAASGFTFSSYGMHWVRQAPGKGLDWVAIIWHDGSNKYYADSVKGRFTISRDNSKKTLYLQMNSLRAEDTAVYYCARAWAYDYGDYEYYFGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 309 - DNA, 1506 bp, Artificial Sequence
  PSMA P3  LH x I2C HL
gacatccagatgacccagtctccctcctccctgtctgcctccgtgggcgacagagtgaccatcacctgccgggcctcccagggcatctctcactacctggcctggttccagcagaagcctggcaaggcccctaagtccctgatctacgccgcctcctctctgcagtccggcgtgccttccaagttctccggctccggctctggcaccgacttcaccctgaccatctccagcctgcagcctgaggacttcgccacctactactgccagcagtacaactccttccctctgaccttcggcggagggaccaaggtggagatcaagggcggagggggctctggcggcggaggaagtggagggggcggatctcaggtgcagctggtcgagtctggcggaggggtggtgcagcctggccggtccctgagactgtcttgtgccgcctccggcttcaccttctcctcttacggcatgcactgggtgcgccaggctccaggcaagggactggactgggtggccatcatctggcacgacggctccaacaagtactacgccgactccgtgaagggccggttcaccatctcccgggacaactccaagaaaaccctgtacctgcagatgaactccctgagggccgaggacaccgccgtgtactactgtgccagggcctgggcctacgactacggcgactacgagtactacttcggcatggacgtgtggggccagggcaccaccgtgacagtgtcttccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 310 - protein, 112 aa, Artificial Sequence
  PSMA P4 L
DIVMTQTPLSLSVTPGQPASISCKSSQSLLHSDGKTFLYWYLQKPGQPPQLLIYEVSNRFSGVPDRFSGSGSGTDFTLKISRVEAEDVGLYYCMQSIQLPLTFGGGTKVEIK

SEQ ID NO: 311 - protein, 16 aa, Artificial Sequence
  PSMA P4 LCDR1
KSSQSLLHSDGKTFLY

SEQ ID NO: 312 - protein, 7 aa, Artificial Sequence
  PSMA P4 LCDR2
EVSNRFS

SEQ ID NO: 313 - protein, 9 aa, Artificial Sequence
  PSMA P4 LCDR3
MQSIQLPLT

SEQ ID NO: 314 - protein, 336 aa, Artificial Sequence
  PSMA P4 VL
GACATCGTGATGACCCAGACCCCTCTGTCCCTGTCTGTGACCCCTGGCCAGCCTGCCTCCATCTCCTGCAAGTCCTCCCAGTCCCTGCTGCACTCCGACGGCAAGACCTTCCTGTACTGGTATCTGCAGAAGCCCGGCCAGCCTCCTCAGCTGCTGATCTACGAGGTGTCCAACCGGTTCTCCGGCGTGCCTGACAGGTTCTCTGGCTCCGGCTCCGGCACCGACTTCACCCTGAAGATCTCCCGGGTGGAGGCTGAGGACGTGGGCCTGTACTACTGCATGCAGTCCATCCAGCTGCCTCTGACCTTCGGCGGAGGGACCAAGGTGGAGATCAAG

SEQ ID NO: 315 - protein, 125 aa, Artificial Sequence
  PSMA P4 H
QVQLVESGGGVVQPGRSLRLSCAASGFTFISYGMHWVRQAPGKGLEWVAVISYDGSNKYYADSVKGRFTISRDNSKNTLYLQMNSLRAEDTAVYYCARVLVGALYYYNYYGMDVWGQGTTVTVSS

SEQ ID NO: 316 - protein, 5 aa, Artificial Sequence
  PSMA P4 HCDR1
SYGMH

SEQ ID NO: 317 - protein, 17 aa, Artificial Sequence
  PSMA P4 HCDR2
VISYDGSNKYYADSVKG

SEQ ID NO: 318 - protein, 16 aa, Artificial Sequence
  PSMA P4 HCDR3
VLVGALYYYNYYGMDV

SEQ ID NO: 319 - DNA, 375 bp, Artificial Sequence
  PSMA P4 H
caggtgcagctggtcgagtctgggggaggggtcgtgcagcctggccggtccctgagactgtcttgcgccgcctccggcttcaccttcatctcttacggcatgcactgggtgcgccaggctccaggcaagggactggaatgggtggccgtgatctcctacgacggctccaacaagtactacgccgactccgtgaagggccggttcaccatctcccgggacaactccaagaacaccctgtacctgcagatgaactccctgagggccgaggacaccgccgtgtactactgtgccagggtgctggtcggcgctctgtactactacaactactacggcatggacgtgtggggccagggcaccaccgtgacagtgtcttcc

SEQ ID NO: 320 - protein, 252 aa, Artificial Sequence
  PSMA P4 LH
DIVMTQTPLSLSVTPGQPASISCKSSQSLLHSDGKTFLYWYLQKPGQPPQLLIYEVSNRFSGVPDRFSGSGSGTDFTLKISRVEAEDVGLYYCMQSIQLPLTFGGGTKVEIKGGGGSGGGGSGGGGSQVQLVESGGGVVQPGRSLRLSCAASGFTFISYGMHWVRQAPGKGLEWVAVISYDGSNKYYADSVKGRFTISRDNSKNTLYLQMNSLRAEDTAVYYCARVLVGALYYYNYYGMDVWGQGTTVTVSS

SEQ ID NO: 321 - DNA, 756 bp, Artificial Sequence
  PSMA P4 LH
gacatcgtgatgacccagacccctctgtccctgtctgtgacccctggccagcctgcctccatctcctgcaagtcctcccagtccctgctgcactccgacggcaagaccttcctgtactggtatctgcagaagcccggccagcctcctcagctgctgatctacgaggtgtccaaccggttctccggcgtgcctgacaggttctctggctccggctccggcaccgacttcaccctgaagatctcccgggtggaggctgaggacgtgggcctgtactactgcatgcagtccatccagctgcctctgaccttcggcggagggaccaaggtggagatcaagggcggagggggctctggcggcggaggaagtggagggggcggatctcaggtgcagctggtcgagtctgggggaggggtcgtgcagcctggccggtccctgagactgtcttgcgccgcctccggcttcaccttcatctcttacggcatgcactgggtgcgccaggctccaggcaagggactggaatgggtggccgtgatctcctacgacggctccaacaagtactacgccgactccgtgaagggccggttcaccatctcccgggacaactccaagaacaccctgtacctgcagatgaactccctgagggccgaggacaccgccgtgtactactgtgccagggtgctggtcggcgctctgtactactacaactactacggcatggacgtgtggggccagggcaccaccgtgacagtgtcttcc

SEQ ID NO: 322 - protein, 506 aa, Artificial Sequence
  PSMA P4  LH x I2C HL
DIVMTQTPLSLSVTPGQPASISCKSSQSLLHSDGKTFLYWYLQKPGQPPQLLIYEVSNRFSGVPDRFSGSGSGTDFTLKISRVEAEDVGLYYCMQSIQLPLTFGGGTKVEIKGGGGSGGGGSGGGGSQVQLVESGGGVVQPGRSLRLSCAASGFTFISYGMHWVRQAPGKGLEWVAVISYDGSNKYYADSVKGRFTISRDNSKNTLYLQMNSLRAEDTAVYYCARVLVGALYYYNYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 323 - DNA, 1518 bp, Artificial Sequence
  PSMA P4  LH x I2C HL
gacatcgtgatgacccagacccctctgtccctgtctgtgacccctggccagcctgcctccatctcctgcaagtcctcccagtccctgctgcactccgacggcaagaccttcctgtactggtatctgcagaagcccggccagcctcctcagctgctgatctacgaggtgtccaaccggttctccggcgtgcctgacaggttctctggctccggctccggcaccgacttcaccctgaagatctcccgggtggaggctgaggacgtgggcctgtactactgcatgcagtccatccagctgcctctgaccttcggcggagggaccaaggtggagatcaagggcggagggggctctggcggcggaggaagtggagggggcggatctcaggtgcagctggtcgagtctgggggaggggtcgtgcagcctggccggtccctgagactgtcttgcgccgcctccggcttcaccttcatctcttacggcatgcactgggtgcgccaggctccaggcaagggactggaatgggtggccgtgatctcctacgacggctccaacaagtactacgccgactccgtgaagggccggttcaccatctcccgggacaactccaagaacaccctgtacctgcagatgaactccctgagggccgaggacaccgccgtgtactactgtgccagggtgctggtcggcgctctgtactactacaactactacggcatggacgtgtggggccagggcaccaccgtgacagtgtcttccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 324 - protein, 107 aa, Artificial Sequence
  PSMA P5 L
AIQLTQSPSSLSASVGDRVTITCRASQGISSALAWYQQKSGKAPKLLIFDASSLESGVPSRFSGSGSGTDFTLTISSLQPEDFATYYCQQFNSYPLTFGGGTKVEIK

SEQ ID NO: 325 - protein, 11 aa, Artificial Sequence
  PSMA P5 LCDR1
RASQGISSALA

SEQ ID NO: 326 - protein, 7 aa, Artificial Sequence
  PSMA P5 LCDR2
DASSLES

SEQ ID NO: 327 - protein, 9 aa, Artificial Sequence
  PSMA P5 LCDR3
QQFNSYPLT

SEQ ID NO: 328 - DNA, 321 bp, Artificial Sequence
  PSMA P5 VL
gccatccagctgacccagagtccctcctccctgtctgcctccgtgggcgacagagtgaccatcacctgccgggcctcccagggcatctcttccgccctggcctggtatcagcagaagtccggcaaggcccctaagctgctgatcttcgacgcctcctctctggaatccggcgtgccttcccggttctccggctctggctccggcaccgacttcaccctgaccatctccagcctgcagcctgaggacttcgccacctactactgccagcagttcaactcctaccctctgaccttcggcggagggaccaaggtggagatcaag

SEQ ID NO: 329 - protein, 124 aa, Artificial Sequence
  PSMA P5 H
QVQLVESGGGVVQPGRSLRLSCAASGFTFSSYAMHWVRQAPGKGLEWVAVISYDGNNKYYADSVKGRFTISRDNSKNTLYLQMNSLRAEDTAVYYCARAVPWGSRYYYYGMDVWGQGTTVTVSS

SEQ ID NO: 330 - protein, 5 aa, Artificial Sequence
  PSMA P5 HCDR1
SYAMH

SEQ ID NO: 331 - protein, 17 aa, Artificial Sequence
  PSMA P5 HCDR2
VISYDGNNKYYADSVKG

SEQ ID NO: 332 - protein, 15 aa, Artificial Sequence
  PSMA P5 HCDR3
AVPWGSRYYYYGMDV

SEQ ID NO: 333 - DNA, 372 bp, Artificial Sequence
  PSMA P5 H
caggtgcagctggtcgagtctgggggaggggtcgtgcagcctggccggtccctgagactgtcttgcgccgcctccggcttcaccttctcctcttacgccatgcactgggtgcgccaggctccaggcaagggactggaatgggtggccgtgatctcctacgacggcaacaacaagtactacgccgactccgtgaagggccggttcaccatctcccgggacaactccaagaacaccctgtacctgcagatgaactccctgagggctgaggacaccgccgtgtactactgcgccagagccgtgccttggggctcccggtactactactacggcatggacgtgtggggccagggcaccaccgtgacagtgtcttcc

SEQ ID NO: 334 - protein, 246 aa, Artificial Sequence
  PSMA P5 LH
AIQLTQSPSSLSASVGDRVTITCRASQGISSALAWYQQKSGKAPKLLIFDASSLESGVPSRFSGSGSGTDFTLTISSLQPEDFATYYCQQFNSYPLTFGGGTKVEIKGGGGSGGGGSGGGGSQVQLVESGGGVVQPGRSLRLSCAASGFTFSSYAMHWVRQAPGKGLEWVAVISYDGNNKYYADSVKGRFTISRDNSKNTLYLQMNSLRAEDTAVYYCARAVPWGSRYYYYGMDVWGQGTTVTVSS

SEQ ID NO: 335 - DNA, 738 bp, Artificial Sequence
  PSMA P5 LH
gccatccagctgacccagagtccctcctccctgtctgcctccgtgggcgacagagtgaccatcacctgccgggcctcccagggcatctcttccgccctggcctggtatcagcagaagtccggcaaggcccctaagctgctgatcttcgacgcctcctctctggaatccggcgtgccttcccggttctccggctctggctccggcaccgacttcaccctgaccatctccagcctgcagcctgaggacttcgccacctactactgccagcagttcaactcctaccctctgaccttcggcggagggaccaaggtggagatcaagggcggagggggctctggcggcggaggaagtggagggggcggatctcaggtgcagctggtcgagtctgggggaggggtcgtgcagcctggccggtccctgagactgtcttgcgccgcctccggcttcaccttctcctcttacgccatgcactgggtgcgccaggctccaggcaagggactggaatgggtggccgtgatctcctacgacggcaacaacaagtactacgccgactccgtgaagggccggttcaccatctcccgggacaactccaagaacaccctgtacctgcagatgaactccctgagggctgaggacaccgccgtgtactactgcgccagagccgtgccttggggctcccggtactactactacggcatggacgtgtggggccagggcaccaccgtgacagtgtcttcc

SEQ ID NO: 336 - protein, 500 aa, Artificial Sequence
  PSMA P5  LH x I2C HL
AIQLTQSPSSLSASVGDRVTITCRASQGISSALAWYQQKSGKAPKLLIFDASSLESGVPSRFSGSGSGTDFTLTISSLQPEDFATYYCQQFNSYPLTFGGGTKVEIKGGGGSGGGGSGGGGSQVQLVESGGGVVQPGRSLRLSCAASGFTFSSYAMHWVRQAPGKGLEWVAVISYDGNNKYYADSVKGRFTISRDNSKNTLYLQMNSLRAEDTAVYYCARAVPWGSRYYYYGMDVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 337 - DNA, 1500 bp, Artificial Sequence
  PSMA P5  LH x I2C HL
gccatccagctgacccagagtccctcctccctgtctgcctccgtgggcgacagagtgaccatcacctgccgggcctcccagggcatctcttccgccctggcctggtatcagcagaagtccggcaaggcccctaagctgctgatcttcgacgcctcctctctggaatccggcgtgccttcccggttctccggctctggctccggcaccgacttcaccctgaccatctccagcctgcagcctgaggacttcgccacctactactgccagcagttcaactcctaccctctgaccttcggcggagggaccaaggtggagatcaagggcggagggggctctggcggcggaggaagtggagggggcggatctcaggtgcagctggtcgagtctgggggaggggtcgtgcagcctggccggtccctgagactgtcttgcgccgcctccggcttcaccttctcctcttacgccatgcactgggtgcgccaggctccaggcaagggactggaatgggtggccgtgatctcctacgacggcaacaacaagtactacgccgactccgtgaagggccggttcaccatctcccgggacaactccaagaacaccctgtacctgcagatgaactccctgagggctgaggacaccgccgtgtactactgcgccagagccgtgccttggggctcccggtactactactacggcatggacgtgtggggccagggcaccaccgtgacagtgtcttccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 338 - protein, 108 aa, Artificial Sequence
  PSMA D1 L
EIVLTQSPATLSLSPGERATLSCRASQSVSSYLAWFQQKPGQAPRLLIYDASNRATGIPARFSGSGSGTDFTLTISSLEPEDFAVYYCQQRSNWLMYTFGQGTKLEIK

SEQ ID NO: 339 - protein, 11 aa, Artificial Sequence
  PSMA D1 LCDR1
RASQSVSSYLA

SEQ ID NO: 340 - protein, 7 aa, Artificial Sequence
  PSMA D1 LCDR2
DASNRAT

SEQ ID NO: 341 - protein, 10 aa, Artificial Sequence
  PSMA D1 LCDR3
QQRSNWLMYT

SEQ ID NO: 342 - DNA, 324 bp, Artificial Sequence
  PSMA D1 VL
gagatcgtgctgacccagtcccctgccaccctgtctctgtctcccggcgagagagccaccctgagctgccgggcctcccagtccgtgtcctcctacctggcctggttccagcagaagcctggacaggcccctaggctgctgatctacgacgcctccaacagggctaccggcatccctgcccggttctccggctctggctccggcaccgacttcaccctgaccatctccagcctggaacctgaggacttcgccgtgtactactgccagcagcggtccaactggctgatgtataccttcggccagggcaccaagctggaaatcaag

SEQ ID NO: 343 - protein, 119 aa, Artificial Sequence
  PSMA D1 H
EVQLVQSGAEVKKPGESLKISCKGSGYSFTSYWIGWARQMPGKGLEWMGIIYPGDSDTRYSPSFQGQVTISADKSISTAYLQWSSLKASDTAMYYCSAANSSHWYFDLWGRGTLVTVSS

SEQ ID NO: 344 - protein, 5 aa, Artificial Sequence
  PSMA D1 HCDR1
SYWIG

SEQ ID NO: 345 - protein, 17 aa, Artificial Sequence
  PSMA D1 HCDR2
IIYPGDSDTRYSPSFQG

SEQ ID NO: 346 - protein, 10 aa, Artificial Sequence
  PSMA D1 HCDR3
ANSSHWYFDL

SEQ ID NO: 347 - DNA, 357 bp, Artificial Sequence
  PSMA D1 H
gaagtgcagctggtgcagtctggcgccgaagtgaagaagcccggcgagtccctgaagatctcctgcaagggctccgggtactccttcacctcctactggatcggctgggccaggcagatgccaggcaagggcctggaatggatgggcatcatctaccctggcgactccgacacccggtactctcccagcttccagggccaggtgaccatctctgccgacaagtccatctccaccgcctacctgcagtggtcctccctgaaggcctccgacaccgccatgtactattgctccgccgccaactcctcccactggtacttcgacctgtggggcagaggcaccctggtgaccgtgtcttcc

SEQ ID NO: 348 - protein, 242 aa, Artificial Sequence
  PSMA D1 LH
EIVLTQSPATLSLSPGERATLSCRASQSVSSYLAWFQQKPGQAPRLLIYDASNRATGIPARFSGSGSGTDFTLTISSLEPEDFAVYYCQQRSNWLMYTFGQGTKLEIKGGGGSGGGGSGGGGSEVQLVQSGAEVKKPGESLKISCKGSGYSFTSYWIGWARQMPGKGLEWMGIIYPGDSDTRYSPSFQGQVTISADKSISTAYLQWSSLKASDTAMYYCSAANSSHWYFDLWGRGTLVTVSS

SEQ ID NO: 349 - DNA, 726 bp, Artificial Sequence
  PSMA D1 LH
gagatcgtgctgacccagtcccctgccaccctgtctctgtctcccggcgagagagccaccctgagctgccgggcctcccagtccgtgtcctcctacctggcctggttccagcagaagcctggacaggcccctaggctgctgatctacgacgcctccaacagggctaccggcatccctgcccggttctccggctctggctccggcaccgacttcaccctgaccatctccagcctggaacctgaggacttcgccgtgtactactgccagcagcggtccaactggctgatgtataccttcggccagggcaccaagctggaaatcaagggcggagggggatctgggggcggaggaagtggagggggcggatccgaagtgcagctggtgcagtctggcgccgaagtgaagaagcccggcgagtccctgaagatctcctgcaagggctccgggtactccttcacctcctactggatcggctgggccaggcagatgccaggcaagggcctggaatggatgggcatcatctaccctggcgactccgacacccggtactctcccagcttccagggccaggtgaccatctctgccgacaagtccatctccaccgcctacctgcagtggtcctccctgaaggcctccgacaccgccatgtactattgctccgccgccaactcctcccactggtacttcgacctgtggggcagaggcaccctggtgaccgtgtcttcc

SEQ ID NO: 350 - protein, 496 aa, Artificial Sequence
  PSMA D1  LH x I2C HL
EIVLTQSPATLSLSPGERATLSCRASQSVSSYLAWFQQKPGQAPRLLIYDASNRATGIPARFSGSGSGTDFTLTISSLEPEDFAVYYCQQRSNWLMYTFGQGTKLEIKGGGGSGGGGSGGGGSEVQLVQSGAEVKKPGESLKISCKGSGYSFTSYWIGWARQMPGKGLEWMGIIYPGDSDTRYSPSFQGQVTISADKSISTAYLQWSSLKASDTAMYYCSAANSSHWYFDLWGRGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 351 - DNA, 1488 bp, Artificial Sequence
  PSMA D1  LH x I2C HL
gagatcgtgctgacccagtcccctgccaccctgtctctgtctcccggcgagagagccaccctgagctgccgggcctcccagtccgtgtcctcctacctggcctggttccagcagaagcctggacaggcccctaggctgctgatctacgacgcctccaacagggctaccggcatccctgcccggttctccggctctggctccggcaccgacttcaccctgaccatctccagcctggaacctgaggacttcgccgtgtactactgccagcagcggtccaactggctgatgtataccttcggccagggcaccaagctggaaatcaagggcggagggggatctgggggcggaggaagtggagggggcggatccgaagtgcagctggtgcagtctggcgccgaagtgaagaagcccggcgagtccctgaagatctcctgcaagggctccgggtactccttcacctcctactggatcggctgggccaggcagatgccaggcaagggcctggaatggatgggcatcatctaccctggcgactccgacacccggtactctcccagcttccagggccaggtgaccatctctgccgacaagtccatctccaccgcctacctgcagtggtcctccctgaaggcctccgacaccgccatgtactattgctccgccgccaactcctcccactggtacttcgacctgtggggcagaggcaccctggtgaccgtgtcttccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 352 - protein, 108 aa, Artificial Sequence
  PSMA D2 L
EIVLTQSPATLSLSPGERATLSCRASQSVSSYLAWYQQKPGQAPRLLIYDASNRATGIPARFSGSGSGTDFTLTISSLEPEDFAVYYCQQRSDWLMYTFGQGTKLEIK

SEQ ID NO: 353 - protein, 11 aa, Artificial Sequence
  PSMA D2 LCDR1
RASQSVSSYLA

SEQ ID NO: 354 - protein, 7 aa, Artificial Sequence
  PSMA D2 LCDR2
DASNRAT

SEQ ID NO: 355 - protein, 10 aa, Artificial Sequence
  PSMA D2 LCDR3
QQRSDWLMYT

SEQ ID NO: 356 - DNA, 324 bp, Artificial Sequence
  PSMA D2 VL
gagatcgtgctgacccagtcccctgccaccctgtctctgtctcccggcgagagagccaccctgagctgccgggcctcccagtccgtgtcctcctacctggcctggtatcagcagaagcctggacaggcccctaggctgctgatctacgacgcctccaacagggctaccggcatccctgcccggttctccggctctggctccggcaccgacttcaccctgaccatctccagcctggaacctgaggacttcgccgtgtactactgccagcagcggtccgactggctgatgtataccttcggccagggcaccaagctggaaatcaag

SEQ ID NO: 357 - protein, 119 aa, Artificial Sequence
  PSMA D2 H
EVQLVQSGAEVKTPGESLKISCKGSGYTFTSYWIGWVRQMPGKGPEWMGIIYPGDSDTRYSPSFQGQVTFSADKSISTAYLQWNSLKTSDTAMYYCATANPSYWYFDLWGRGTLVTVSS

SEQ ID NO: 358 - protein, 5 aa, Artificial Sequence
  PSMA D2 HCDR1
SYWIG

SEQ ID NO: 359 - protein, 17 aa, Artificial Sequence
  PSMA D2 HCDR2
IIYPGDSDTRYSPSFQG

SEQ ID NO: 360 - protein, 10 aa, Artificial Sequence
  PSMA D2 HCDR3
ANPSYWYFDL

SEQ ID NO: 361 - DNA, 357 bp, Artificial Sequence
  PSMA D2 H
gaagtgcagctggtgcagtctggcgccgaagtgaaaacccctggcgagtccctgaagatctcctgcaagggctccggctacaccttcacctcttactggatcggctgggtgcgccagatgcctggcaagggccctgagtggatgggcatcatctaccctggcgactccgacacccggtactctcccagcttccagggccaggtgaccttctccgccgacaagtccatctccaccgcctacctgcagtggaactccctgaaaacctccgacaccgccatgtactattgcgccaccgccaaccctagctactggtacttcgacctgtggggcagaggcaccctggtgaccgtgtcttcc

SEQ ID NO: 362 - protein, 242 aa, Artificial Sequence
  PSMA D2 LH
EIVLTQSPATLSLSPGERATLSCRASQSVSSYLAWYQQKPGQAPRLLIYDASNRATGIPARFSGSGSGTDFTLTISSLEPEDFAVYYCQQRSDWLMYTFGQGTKLEIKGGGGSGGGGSGGGGSEVQLVQSGAEVKTPGESLKISCKGSGYTFTSYWIGWVRQMPGKGPEWMGIIYPGDSDTRYSPSFQGQVTFSADKSISTAYLQWNSLKTSDTAMYYCATANPSYWYFDLWGRGTLVTVSS

SEQ ID NO: 363 - DNA, 726 bp, Artificial Sequence
  PSMA D2 LH
gagatcgtgctgacccagtcccctgccaccctgtctctgtctcccggcgagagagccaccctgagctgccgggcctcccagtccgtgtcctcctacctggcctggtatcagcagaagcctggacaggcccctaggctgctgatctacgacgcctccaacagggctaccggcatccctgcccggttctccggctctggctccggcaccgacttcaccctgaccatctccagcctggaacctgaggacttcgccgtgtactactgccagcagcggtccgactggctgatgtataccttcggccagggcaccaagctggaaatcaagggcggagggggatctggcggcggaggaagtggagggggcggatccgaagtgcagctggtgcagtctggcgccgaagtgaaaacccctggcgagtccctgaagatctcctgcaagggctccggctacaccttcacctcttactggatcggctgggtgcgccagatgcctggcaagggccctgagtggatgggcatcatctaccctggcgactccgacacccggtactctcccagcttccagggccaggtgaccttctccgccgacaagtccatctccaccgcctacctgcagtggaactccctgaaaacctccgacaccgccatgtactattgcgccaccgccaaccctagctactggtacttcgacctgtggggcagaggcaccctggtgaccgtgtcttcc

SEQ ID NO: 364 - protein, 496 aa, Artificial Sequence
  PSMA D2  LH x I2C HL
EIVLTQSPATLSLSPGERATLSCRASQSVSSYLAWYQQKPGQAPRLLIYDASNRATGIPARFSGSGSGTDFTLTISSLEPEDFAVYYCQQRSDWLMYTFGQGTKLEIKGGGGSGGGGSGGGGSEVQLVQSGAEVKTPGESLKISCKGSGYTFTSYWIGWVRQMPGKGPEWMGIIYPGDSDTRYSPSFQGQVTFSADKSISTAYLQWNSLKTSDTAMYYCATANPSYWYFDLWGRGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 365 - DNA, 1488 bp, Artificial Sequence
  PSMA D2  LH x I2C HL
gagatcgtgctgacccagtcccctgccaccctgtctctgtctcccggcgagagagccaccctgagctgccgggcctcccagtccgtgtcctcctacctggcctggtatcagcagaagcctggacaggcccctaggctgctgatctacgacgcctccaacagggctaccggcatccctgcccggttctccggctctggctccggcaccgacttcaccctgaccatctccagcctggaacctgaggacttcgccgtgtactactgccagcagcggtccgactggctgatgtataccttcggccagggcaccaagctggaaatcaagggcggagggggatctggcggcggaggaagtggagggggcggatccgaagtgcagctggtgcagtctggcgccgaagtgaaaacccctggcgagtccctgaagatctcctgcaagggctccggctacaccttcacctcttactggatcggctgggtgcgccagatgcctggcaagggccctgagtggatgggcatcatctaccctggcgactccgacacccggtactctcccagcttccagggccaggtgaccttctccgccgacaagtccatctccaccgcctacctgcagtggaactccctgaaaacctccgacaccgccatgtactattgcgccaccgccaaccctagctactggtacttcgacctgtggggcagaggcaccctggtgaccgtgtcttccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 366 - DNA, 2283 bp, Artificial Sequence
  human FAP-alpha  construct
atgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaa

SEQ ID NO: 367 - protein, 760 aa, Artificial Sequence
  human FAP-alpha  construct
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 368 - DNA, 3570 bp, Artificial Sequence
  soluble fusion protein of h FAP-alpha  and m Lag3
atgagggaggacctgctccttggctttttgcttctgggactgctttgggaagctccagttgtgtcttcagggcctgggaaagagctccccgtggtgtgggcccaggagggagctcccgtccatcttccctgcagcctcaaatcccccaacctggatcctaactttctacgaagaggaggggttatctggcaacatcaaccagacagtggccaacccactcccatcccggcccttgaccttcaccaggggatgccctcgcctagacaacccgcacccggtcgctacacggtgctgagcgtggctccaggaggcctgcgcagcgggaggcagcccctgcatccccacgtgcagctggaggagcgcggcctccagcgcggggacttctctctgtggttgcgcccagctctgcgcaccgatgcgggcgagtaccacgccaccgtgcgcctcccgaaccgcgccctctcctgcagtctccgcctgcgcgtcggccaggcctcgatgattgctagtccctcaggagtcctcaagctgtctgattgggtccttttgaactgctccttcagccgtcctgaccgcccagtctctgtgcactggttccagggccagaaccgagtgcctgtctacaactcaccgcgtcattttttagctgaaactttcctgttactgccccaagtcagccccctggactctgggacctggggctgtgtcctcacctacagagatggcttcaatgtctccatcacgtacaacctcaaggttctgggtctggagcccgtagcccctctgacagtgtacgctgctgaaggttctagggtggagctgccctgtcatttgcccccaggagtggggaccccttctttgctcattgccaagtggactcctcctggaggaggtcctgagctccccgtggctggaaagagtggcaattttacccttcaccttgaggctgtgggtctggcacaggctgggacctacacctgtagcatccatctgcagggacagcagctcaatgccactgtcacgttggcggtcatcacagtgactcccaaatccttcgggttacctggctcccgggggaagctgttgtgtgaggtaaccccggcatctggaaaggaaagatttgtgtggcgtcccctgaacaatctgtccaggagttgcccgggccctgtgctggagattcaggaggccaggctccttgctgagcgatggcagtgtcagctgtacgagggccagaggcttcttggagcgacagtgtacgccgcagagtctagctcaggcgcccacagtgctaggagaatctcaggtgaccttaaaggaggccattccggaggtggtggatcccgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactccgggcatcatcaccatcatcattga

SEQ ID NO: 369 - protein, 1189 aa, Artificial Sequence
  soluble fusion protein of h FAP-alpha and m Lag3
MREDLLLGFLLLGLLWEAPVVSSGPGKELPVVWAQEGAPVHLPCSLKSPNLDPNFLRRGGVIWQHQPDSGQPTPIPALDLHQGMPSPRQPAPGRYTVLSVAPGGLRSGRQPLHPHVQLEERGLQRGDFSLWLRPALRTDAGEYHATVRLPNRALSCSLRLRVGQASMIASPSGVLKLSDWVLLNCSFSRPDRPVSVHWFQGQNRVPVYNSPRHFLAETFLLLPQVSPLDSGTWGCVLTYRDGFNVSITYNLKVLGLEPVAPLTVYAAEGSRVELPCHLPPGVGTPSLLIAKWTPPGGGPELPVAGKSGNFTLHLEAVGLAQAGTYTCSIHLQGQQLNATVTLAVITVTPKSFGLPGSRGKLLCEVTPASGKERFVWRPLNNLSRSCPGPVLEIQEARLLAERWQCQLYEGQRLLGATVYAAESSSGAHSARRISGDLKGGHSGGGGSRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDSGHHHHHH

SEQ ID NO: 370 - DNA, 2310 bp, Artificial Sequence
  murine FAP-alpha construct
atgaagacatggctgaaaactgtctttggagttaccaccctggctgcgcttgctttagtggtgatatgcattgtcttacgtccctcaagagtttacaaacctgaaggaaacacaaagagagctcttaccttgaaggatattttaaatggaacattctcatataaaacatattttcccaactggatttcagaacaagaatatcttcatcaatctgaggatgataacatagtattttataatattgaaacaagagaatcatatatcattttgagtaatagcaccatgaaaagtgtgaatgctacagattatggtttgtcacctgatcggcaatttgtgtatctagaaagtgattattcaaagctctggcgatattcatacacagcgacatactacatctacgaccttcagaatggggaatttgtaagaggatacgagctccctcgtccaattcagtatctatgctggtcgcctgttgggagtaaattagcatatgtatatcaaaacaatatttatttgaaacaaagaccaggagatccaccttttcaaataacttatactggaagagaaaatagaatatttaatggaataccagactgggtttatgaagaggaaatgcttgccacaaaatatgctctttggtggtctccagatggaaaatttttggcatatgtagaatttaatgattcagatataccaattattgcctattcttattatggtgatggacagtatcctagaactataaatattccatatccaaaggctggggctaagaatccggttgttcgtgtttttattgttgacaccacctaccctcaccacgtgggcccaatggaagtgccagttccagaaatgatagcctcaagtgactattatttcagctggctcacatgggtgtccagtgaacgagtatgcttgcagtggctaaaaagagtgcagaatgtctcagtcctgtctatatgtgatttcagggaagactggcatgcatgggaatgtccaaagaaccaggagcatgtagaagaaagcagaacaggatgggctggtggattctttgtttcgacaccagcttttagccaggatgccacttcttactacaaaatatttagcgacaaggatggttacaaacatattcactacatcaaagacactgtggaaaatgctattcaaattacaagtggcaagtgggaggccatatatatattccgcgtaacacaggattcactgttttattctagcaatgaatttgaaggttaccctggaagaagaaacatctacagaattagcattggaaactctcctccgagcaagaagtgtgttacttgccatctaaggaaagaaaggtgccaatattacacagcaagtttcagctacaaagccaagtactatgcactcgtctgctatggccctggcctccccatttccaccctccatgatggccgcacagaccaagaaatacaagtattagaagaaaacaaagaactggaaaattctctgagaaatatccagctgcctaaagtggagattaagaagctcaaagacgggggactgactttctggtacaagatgattctgcctcctcagtttgacagatcaaagaagtaccctttgctaattcaagtgtatggtggtccttgtagccagagtgttaagtctgtgtttgctgttaattggataacttatctcgcaagtaaggaggggatagtcattgccctggtagatggtcggggcactgctttccaaggtgacaaattcctgcatgccgtgtatcgaaaactgggtgtatatgaagttgaggaccagctcacagctgtcagaaaattcatagaaatgggtttcattgatgaagaaagaatagccatatggggctggtcctacggaggttatgtttcatccctggcccttgcatctggaactggtcttttcaaatgtggcatagcagtggctccagtctccagctgggaatattacgcatctatctactcagagagattcatgggcctcccaacaaaggacgacaatctcgaacactataaaaattcaactgtgatggcaagagcagaatatttcagaaatgtagactatcttctcatccacggaacagcagatgataatgtgcactttcagaactcagcacagattgctaaagctttggttaatgcacaagtggatttccaggcgatgtggtactctgaccagaaccatggtatatcatctgggcgctcccagaatcatttatatacccacatgacgcacttcctcaagcaatgcttttctttatcagacgattacaaggacgacgatgacaagtga

SEQ ID NO: 371 - protein, 769 aa, Artificial Sequence
  murine FAP-alpha construct
MKTWLKTVFGVTTLAALALVVICIVLRPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGISSGRSQNHLYTHMTHFLKQCFSLSDDYKDDDDK

SEQ ID NO: 372 - DNA, 2307 bp, Artificial Sequence
  mutated human FAP-alpha antigen
atgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggatacgagcttcctcgtccaattcagtatttatgctggtcgcctgttgggagtaaattagcatatgtctatcaaaacaatatctatttgaaacaaagaccaggagatccaccttttcaaataacatatactggaagagaaaataaaatatttaatggaatcccagactgggtttatgaagaggaaatgcttgctacaaaatatgctctctggtggtctcctaatggaaaatttttggcatatgcggaatttaatgattcagatataccagttattgcctattcctattatggcgatgaacaatatcctagaacaataaatattccatacccaaaggctggagctaagaatcccgttgttcggatatttattgttgataccacttaccctcaccacgtaggtcccatggaagtgcctgttccagaaatgatagcctcaagtgattattatttcagttggctcacgtgggttactagtgaacgagtatgtttgcagtggctaaaaagagtccagaatgtttcggtcctgtctatatgtgacttcagggaagactggcatgcatgggaatgtccaaagaaccaggagcatatagaagaaagcagaactggatgggctggtggattctttgtttcaacaccagttttcagctatgatgccacttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaactcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagacgattacaaggacgacgatgacaagtaa

SEQ ID NO: 373 - protein, 768 aa, Artificial Sequence
  mutated human FAP-alpha antigen
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGYELPRPIQYLCWSPVGSKLAYVYQNNIYLKQRPGDPPFQITYTGRENKIFNGIPDWVYEEEMLATKYALWWSPNGKFLAYAEFNDSDIPVIAYSYYGDEQYPRTINIPYPKAGAKNPVVRIFIVDTTYPHHVGPMEVPVPEMIASSDYYFSWLTWVTSERVCLQWLKRVQNVSVLSICDFREDWHAWECPKNQEHIEESRTGWAGGFFVSTPVFSYDATSYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDDYKDDDDK

SEQ ID NO: 374 - DNA, 2310 bp, Artificial Sequence
  mutated murine FAP-alpha antigen
atgaagacatggctgaaaactgtctttggagttaccaccctggctgcgcttgctttagtggtgatatgcattgtcttacgtccctcaagagtttacaaacctgaaggaaacacaaagagagctcttaccttgaaggatattttaaatggaacattctcatataaaacatattttcccaactggatttcagaacaagaatatcttcatcaatctgaggatgataacatagtattttataatattgaaacaagagaatcatatatcattttgagtaatagcaccatgaaaagtgtgaatgctacagattatggtttgtcacctgatcggcaatttgtgtatctagaaagtgattattcaaagctctggcgatattcatacacagcgacatactacatctacgaccttcagaatggggaatttgtaagaggaaacgagctccctcgtccaattcagtatctatgctggtcgcctgttgggagtaaattagcatatgtatatcaaaacaatatttatttgaaacaaagaccaggagatccaccttttcaaataacttttaatggaagagaaaatagaatatttaatggaataccagactgggtttatgaagaggaaatgcttgccacaaaatatgctctttggtggtctccagatggaaaatttttggcatatgtagaatttaatgatacggatataccaattattgcctattcttattatggtgatggacagtatcctagaactataaatattccatatccaaaggctggggctaagaatccggttgttcgtgtttttattattgacaccacctaccctgcctacgtgggcccacaggaagtgccagttccagcaatgatagcctcaagtgactattatttcagctggctcacatgggtgtccgatgaacgagtatgcttgcagtggctaaaaagagtgcagaatgtctcagtcctgtctatatgtgatttcagggaagactggcagacatgggattgtccaaagacccaggagcatgtagaagaaagcagaacaggatgggctggtggattctttgtttcgacaccagcttttagccaggatgccatttcttactacaaaatatttagcgacaaggatggttacaaacatattcactacatcaaagacactgtggaaaatgctattcaaattacaagtggcaagtgggaggccatatatatattccgcgtaacacaggattcactgttttattctagcaatgaatttgaaggttaccctggaagaagaaacatctacagaattagcattggaaactctcctccgagcaagaagtgtgttacttgccatctaaggaaagaaaggtgccaatattacacagcaagtttcagctacaaagccaagtactatgcactcgtctgctatggccctggcctccccatttccaccctccatgatggccgcacagaccaagaaatacaagtattagaagaaaacaaagaactggaaaattctctgagaaatatccagctgcctaaagtggagattaagaagctcaaagacgggggactgactttctggtacaagatgattctgcctcctcagtttgacagatcaaagaagtaccctttgctaattcaagtgtatggtggtccttgtagccagagtgttaagtctgtgtttgctgttaattggataacttatctcgcaagtaaggaggggatagtcattgccctggtagatggtcggggcactgctttccaaggtgacaaattcctgcatgccgtgtatcgaaaactgggtgtatatgaagttgaggaccagctcacagctgtcagaaaattcatagaaatgggtttcattgatgaagaaagaatagccatatggggctggtcctacggaggttatgtttcatccctggcccttgcatctggaactggtcttttcaaatgtggcatagcagtggctccagtctccagctgggaatattacgcatctatctactcagagagattcatgggcctcccaacaaaggacgacaatctcgaacactataaaaattcaactgtgatggcaagagcagaatatttcagaaatgtagactatcttctcatccacggaacagcagatgataatgtgcactttcagaactcagcacagattgctaaagctttggttaatgcacaagtggatttccaggcgatgtggtactctgaccagaaccatggtatatcatctgggcgctcccagaatcatttatatacccacatgacgcacttcctcaagcaatgcttttctttatcagacgattacaaggacgacgatgacaagtag

SEQ ID NO: 375 - protein, 769 aa, Artificial Sequence
  mutated murine FAP-alpha antigen
MKTWLKTVFGVTTLAALALVVICIVLRPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGNELPRPIQYLCWSPVGSKLAYVYQNNIYLKQRPGDPPFQITFNGRENRIFNGIPDWVYEEEMLATKYALWWSPDGKFLAYVEFNDTDIPIIAYSYYGDGQYPRTINIPYPKAGAKNPVVRVFIIDTTYPAYVGPQEVPVPAMIASSDYYFSWLTWVSDERVCLQWLKRVQNVSVLSICDFREDWQTWDCPKTQEHVEESRTGWAGGFFVSTPAFSQDAISYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGISSGRSQNHLYTHMTHFLKQCFSLSDDYKDDDDK

SEQ ID NO: 376 - DNA, 24 bp, Artificial Sequence
  macaque FAP-alpha forward primer
cagcttccaactacaaagacagac

SEQ ID NO: 377 - DNA, 25 bp, Artificial Sequence
  macaque FAP-alpha reverse primer
tttcctcttcataaacccagtctgg

SEQ ID NO: 378 - DNA, 26 bp, Artificial Sequence
  macaque FAP-alpha forward primer
ttgaaacaaagaccaggagatccacc

SEQ ID NO: 379 - DNA, 25 bp, Artificial Sequence
  macaque FAP-alpha reverse primer
agatggcaagtaacacacttcttgc

SEQ ID NO: 380 - DNA, 28 bp, Artificial Sequence
  macaque FAP-alpha forward primer
gaagaaacatctacagaattagcattgg

SEQ ID NO: 381 - DNA, 28 bp, Artificial Sequence
  macaque FAP-alpha reverse primer
cacatttgaaaagaccagttccagatgc

SEQ ID NO: 382 - DNA, 33 bp, Artificial Sequence
  macaque FAP-alpha forward primer
agattacagctgtcagaaaattcatagaaatgg

SEQ ID NO: 383 - DNA, 29 bp, Artificial Sequence
  macaque FAP-alpha reverse primer
atataaggttttcagattctgatacaggc

SEQ ID NO: 384 - DNA, 2283 bp, Artificial Sequence
  macaque FAP-alpha
atgaagacttgggtaaaaatcgtatttggagttgccacctctgctgtgcttgccttattggtgatgtgcattgtcttacgccctccaagagttcataactctgaagaaaatacaatgagagcactcacactgaaggatattttaaatgggacattttcttataaaacattttttccaaactggatttcaggacaagaatatcttcatcaatctgcagataacaatatagtactttataatattgaaacaggacaatcatataccattttgagtaacagaaccatgaaaagtgtgaatgcttcaaattatggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacagatataccagttattgcctattcctattatggcgatgaacaatatcccagaacaataaatattccatacccaaaggcyggagctaagaatccttttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcttgtctatatgtgatttcagggaagactggcagacatgggattgtccaaagacccaggagcatatagaagaaagcagaactggatgggctggtggattctttgtttcaacaccagttttcagctatgatgccatttcatactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagattaccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctatggcccaggcatccccatttccacccttcatgacggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtraggtctgtatttgctgttaattggatatcktatcttgcaagtaaggaagggatggtcattgccttggtggatggtcgaggaacagctttccaaggtgacaaactcctgtatgcagtgtatcgaaagctgggtgtttatgaagttgaagaccagattacagctgtcagaaaattcatagaaatgggtttcattgatgaaaaaagaatagccatatggggctggtcctatggaggataygtttcatcactggcccttgcatctggaactggtcttttcaaatgtgggatagcagtggctccagtctccagctgggaatattacgcgtctgtctacacagaaagattcatgggtcttcccacaaaggatgataatcttgagcactacaaaaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccactttctaaagcagtgtttttctttgtcggactaa

SEQ ID NO: 385 - protein, 760 aa, Artificial Sequence
  macaque FAP-alpha
MKTWVKIVFGVATSAVLALLVMCIVLRPPRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPFVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEDYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 386 - DNA, 4173 bp, Artificial Sequence
  human C-MET construct
atgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtggacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaatagcagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaactcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatag

SEQ ID NO: 387 - protein, 1390 aa, Artificial Sequence
  human C-MET construct
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 388 - DNA, 3522 bp, Artificial Sequence
  soluble fusion protein of h C-MET and m IgG1 Fc
atgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtggacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaatagcagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaactcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacatccggaggtggtggatccgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgaaaccccgggaggagcagatcaacagcactttccgttcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacaaacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatccgggcatcatcaccatcatcattga

SEQ ID NO: 389 - protein, 1173 aa, Artificial Sequence
  soluble fusion protein of h C-MET and m IgG1 Fc
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTSGGGGSVPRDCGCKPCICTVPEVSSVFIFPPKPKDVLTITLTPKVTCVVVDISKDDPEVQFSWFVDDVEVHTAQTKPREEQINSTFRSVSELPIMHQDWLNGKEFKCRVNSAAFPAPIEKTISKTKGRPKAPQVYTIPPPKEQMAKDKVSLTCMITNFFPEDITVEWQWNGQPAENYKNTQPIMDTDGSYFVYSKLNVQKSNWEAGNTFTCSVLHEGLHNHHTEKSLSHSPGKSGHHHHHH

SEQ ID NO: 390 - DNA, 4149 bp, Artificial Sequence
  murine C-MET construct
atgggatggagctgtatcatcctcttcttggtagcaacagctacaggtgtacactccgattacaaggacgacgatgacaaggagtgcaaggaggccctagtgaagtctgagatgaacgtgaacatgaagtatcagctccccaacttcacggcagaaacccccatccagaatgtcgtcctacacggccatcatatttatctcggagccacaaactacatttatgttttaaatgacaaagaccttcagaaggtatccgagttcaagaccgggcccgtgttggaacacccagattgtttaccttgtcgggactgcagcagcaaagccaattcatcaggaggggtttggaaagacaacatcaacatggctctgcttgttgacacatactatgatgatcaactcattagctgtggcagtgtcaacagagggacttgccagcggcatgtccttcctcctgacaattctgctgacatccagtctgaggtccactgcatgttctccccagaagaggagtcagggcagtgtcctgactgtgtagtgagtgccctcggagccaaagtcctcctgtcggaaaaggaccggttcatcaatttctttgtggggaatacgatcaattcctcctatcctcctggttattcactgcattcgatatcggtgagacggctgaaggaaacccaagatggttttaagtttttgacagaccagtcctatattgatgtcttaccagagttccaagattcctaccccataaagtacatacatgccttcgaaagcaaccattttatttactttctgactgtccaaaaggaaactctagatgctcagacttttcatacaagaataatcaggttctgttccgtagactctgggttgcactcctacatggaaatgcccctggaatgcatcctgacagaaaaaagaaggaagagatccacaagggaagaagtgtttaatatcctccaagccgcgtatgtcagtaaaccaggggccaatcttgctaagcaaataggagctagcccttctgatgacattctcttcggggtgtttgcacaaagcaagccagattctgctgaacctgtgaatcgatcagcagtctgtgcattccccatcaaatatgtcaatgacttcttcaacaagattgtcaacaaaaacaacgtgagatgtctccagcatttttacggacccaaccatgagcactgtttcaataggaccctgctgagaaactcttccggctgtgaagcgcgcagtgacgagtatcggacagagtttaccacggctttgcagcgcgtcgatttattcatgggccggcttaaccaagtgctcctgacatccatctccaccttcatcaaaggtgacctcaccattgctaatctagggacgtcagaaggtcgcttcatgcaggtggtgctctctcgaacagcacacctcactcctcatgtgaacttcctcctggactcccatcctgtatctccagaagttattgttgagcatccatcaaatcaaaatggctatacattggttgtcacaggaaagaagatcaccaagattccattgaatggcctgggctgtggacatttccaatcctgcagtcagtgcctctctgccccttactttatacagtgtggctggtgccacaatcaatgtgtgcgttttgatgaatgccccagcggtacatggactcaagagatctgtctgccggcggtttataaggtgttccccaccagcgcgccccttgaaggaggaacagtgttgaccatatgtggctgggactttggattcaggaagaataataaatttgatttaaggaaaaccaaagttctgcttggcaacgagagctgtaccttgaccttaagcgagagcacgacaaatacgttgaaatgcacagttggtcccgcgatgagtgagcacttcaatgtgtctgtaattatctcaaacagtcgagagacgacgcaatacagtgcattctcctatgtagatcctgtaataacaagcatttctccgaggtacggccctcaggctggaggcaccttactcactcttactgggaaatacctcaacagtggcaattctagacacatttcaattggagggaaaacatgtactttaaaaagtgtatcagatagtattcttgaatgctacaccccagcccaaactacctctgatgagtttcctgtgaaattgaagattgacttggctaaccgagagaccagcagcttcagttaccgggaagaccccgttgtctatgaaatccacccgaccaaatcttttattagtggtggaagcacaataacgggtattgggaagaccctgaactcggttagcctcccaaagctggtaatagatgtgcatgaagtgggtgtgaactacacagtggcatgtcagcatcgctcaaattcagagatcatctgctgcactactccttcactgaaacagctgggcctgcaactccccctgaagaccaaagccttcttcctgttagacgggattctttccaaacactttgatctcacttatgtgcataatcctgtgtttgagccttttgaaaagccagtaatgatctcaataggcaatgaaaatgtagtggaaattaagggaaacaatattgaccctgaagcagttaaaggtgaagtgttaaaagttggaaatcagagctgcgagagtctccactggcactctggagctgtgttgtgtacagtccccagtgacctgctcaaactgaacagcgagctaaatatagagtggaagcaagcagtctcttcaactgttcttggaaaagtgatcgttcaaccggatcagaattttgcaggattgatcattggtgcggtctcaatatcagtagtagttttgttattatccgggctcttcctgtggatgagaaagagaaagcataaagatctgggcagtgaattagttcgctatgacgcaagagtacacactcctcatttggataggcttgtaagtgcccgaagtgtaagtccaactacagagatggtttcaaatgagtctgtagactacagagctacttttccagaagaccagtttcccaactcctctcagaatggagcatgcagacaagtgcaataccctctgacagacctgtcccctatcctgacaagtggagactctgatatatccagcccattactacaaaatactgttcacattgacctcagtgctctaaatccagagctggtccaagcagttcagcacgtagtgattggacccagcagcctgattgtgcatttcaatgaagtcataggaagagggcattttggctgtgtctatcatgggactttgctggacaatgacggaaagaaaattcactgtgctgtgaaatccttaaatagaatcacagatatagaagaggtctcccagtttctgactgagggaatcatcatgaaagacttcagccatcccaatgttctctcactcttgggaatctgcctgaggagtgaagggtctcctctggtggtcctgccctatatgaagcatggagatctgcgaaatttcattcgaaacgagactcataatccaactgtgaaagatcttataggatttggccttcaagtagccaaaggcatgaaatatcttgccagcaaaaagtttgtccacagagacttagctgcaagaaactgcatgttggatgaaaaattcactgtcaaggttgctgatttcggtcttgccagagacatgtacgataaagagtactatagtgtccacaacaagacgggtgccaagctaccagtaaagtggatggctttagagagtctgcaaacgcagaagttcaccaccaagtcagatgtgtggtcctttggtgtgctcctctgggagctcatgacgagaggagcccctccttatcccgacgtgaacacatttgatatcactatctacctgttgcaaggcagaagactcttgcaaccagaatactgtccagacgccttgtacgaagtgatgctaaaatgctggcaccccaaagcggaaatgcgcccgtccttttccgaactggtctccaggatatcctcaatcttctccacgttcattggggaacactacgtccacgtgaacgctacttatgtgaatgtaaaatgtgttgctccatatccttctctgttgccatcccaagacaacattgatggcgaggggaacacatga

SEQ ID NO: 391 - protein, 1382 aa, Artificial Sequence
  murine C-MET construct
MGWSCIILFLVATATGVHSDYKDDDDKECKEALVKSEMNVNMKYQLPNFTAETPIQNVVLHGHHIYLGATNYIYVLNDKDLQKVSEFKTGPVLEHPDCLPCRDCSSKANSSGGVWKDNINMALLVDTYYDDQLISCGSVNRGTCQRHVLPPDNSADIQSEVHCMFSPEEESGQCPDCVVSALGAKVLLSEKDRFINFFVGNTINSSYPPGYSLHSISVRRLKETQDGFKFLTDQSYIDVLPEFQDSYPIKYIHAFESNHFIYFLTVQKETLDAQTFHTRIIRFCSVDSGLHSYMEMPLECILTEKRRKRSTREEVFNILQAAYVSKPGANLAKQIGASPSDDILFGVFAQSKPDSAEPVNRSAVCAFPIKYVNDFFNKIVNKNNVRCLQHFYGPNHEHCFNRTLLRNSSGCEARSDEYRTEFTTALQRVDLFMGRLNQVLLTSISTFIKGDLTIANLGTSEGRFMQVVLSRTAHLTPHVNFLLDSHPVSPEVIVEHPSNQNGYTLVVTGKKITKIPLNGLGCGHFQSCSQCLSAPYFIQCGWCHNQCVRFDECPSGTWTQEICLPAVYKVFPTSAPLEGGTVLTICGWDFGFRKNNKFDLRKTKVLLGNESCTLTLSESTTNTLKCTVGPAMSEHFNVSVIISNSRETTQYSAFSYVDPVITSISPRYGPQAGGTLLTLTGKYLNSGNSRHISIGGKTCTLKSVSDSILECYTPAQTTSDEFPVKLKIDLANRETSSFSYREDPVVYEIHPTKSFISGGSTITGIGKTLNSVSLPKLVIDVHEVGVNYTVACQHRSNSEIICCTTPSLKQLGLQLPLKTKAFFLLDGILSKHFDLTYVHNPVFEPFEKPVMISIGNENVVEIKGNNIDPEAVKGEVLKVGNQSCESLHWHSGAVLCTVPSDLLKLNSELNIEWKQAVSSTVLGKVIVQPDQNFAGLIIGAVSISVVVLLLSGLFLWMRKRKHKDLGSELVRYDARVHTPHLDRLVSARSVSPTTEMVSNESVDYRATFPEDQFPNSSQNGACRQVQYPLTDLSPILTSGDSDISSPLLQNTVHIDLSALNPELVQAVQHVVIGPSSLIVHFNEVIGRGHFGCVYHGTLLDNDGKKIHCAVKSLNRITDIEEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITIYLLQGRRLLQPEYCPDALYEVMLKCWHPKAEMRPSFSELVSRISSIFSTFIGEHYVHVNATYVNVKCVAPYPSLLPSQDNIDGEGNT

SEQ ID NO: 392 - DNA, 4179 bp, Artificial Sequence
  mutated human C-MET antigen
atgggatggagctgtatcatcctcttcttggtagcaacagctacaggtgtacactccgattacaaggacgacgatgacaaggagtgcaaggaggccctagtgaagtctgagatgaacgtgaacatgaagtatcagctccccaacttcacggcagaaacccccatccagaatgtcgtcctacacggccatcatatttatctcggagccacaaactacatttatgttttaaatgacaaagaccttcagaaggtatccgagttcaagaccgggcccgtgttggaacacccagattgtttaccttgtcgggactgcagcagcaaagccaattcatcaggaggggtttggaaagacaacatcaacatggctctgcttgttgacacatactatgatgatcaactcattagctgtggcagtgtcaacagagggacttgccagcggcatgtccttcctcctgacaattctgctgacatccagtctgaggtccactgcatgttctccccagaagaggagtcagggcagtgtcctgactgtgtagtgagtgccctcggagccaaagtcctcctgtcggaaaaggaccggttcatcaatttctttgtggggaatacgatcaattcctcctatcctcctggttattcactgcattcgatatcggtgagacggctgaaggaaacccaagatggttttaagtttttgacagaccagtcctatattgatgtcttaccagagttccaagattcctaccccataaagtacatacatgccttcgaaagcaaccattttatttactttctgactgtccaaaaggaaactctagatgctcagacttttcatacaagaataatcaggttctgttccgtagactctgggttgcactcctacatggaaatgcccctggaatgcatcctgacagaaaaaagaaggaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaactctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaactcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtcgtcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatag

SEQ ID NO: 393 - protein, 1392 aa, Artificial Sequence
  mutated human C-MET antigen
MGWSCIILFLVATATGVHSDYKDDDDKECKEALVKSEMNVNMKYQLPNFTAETPIQNVVLHGHHIYLGATNYIYVLNDKDLQKVSEFKTGPVLEHPDCLPCRDCSSKANSSGGVWKDNINMALLVDTYYDDQLISCGSVNRGTCQRHVLPPDNSADIQSEVHCMFSPEEESGQCPDCVVSALGAKVLLSEKDRFINFFVGNTINSSYPPGYSLHSISVRRLKETQDGFKFLTDQSYIDVLPEFQDSYPIKYIHAFESNHFIYFLTVQKETLDAQTFHTRIIRFCSVDSGLHSYMEMPLECILTEKRRKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVVLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 394 - DNA, 4152 bp, Artificial Sequence
  mutated murine C-MET antigen
atgggatggagctgtatcatcctcttcttggtagcaacagctacaggtgtacactccgattacaaggacgacgatgacaaggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgatacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaagggaagaagtgtttaatatcctccaagccgcgtatgtcagtaaaccaggggccaatcttgctaagcaaataggagctagcccttctgatgacattctcttcggggtgtttgcacaaagcaagccagattctgctgaacctgtgaatcgatcagcagtctgtgcattccccatcaaatatgtcaatgacttcttcaacaagattgtcaacaaaaacaacgtgagatgtctccagcatttttacggacccaaccatgagcactgtttcaataggaccctgctgagaaactcttccggctgtgaagcgcgcagtgacgagtatcggacagagtttaccacggctttgcagcgcgtcgatttattcatgggccggcttaaccaagtgctcctgacatccatctccaccttcatcaaaggtgacctcaccattgctaatctagggacgtcagaaggtcgcttcatgcaggtggtgctctctcgaacagcacacctcactcctcatgtgaacttcctcctggactcccatcctgtatctccagaagttattgttgagcatccatcaaatcaaaatggctatacattggttgtcacaggaaagaagatcaccaagattccattgaatggcctgggctgtggacatttccaatcctgcagtcagtgcctctctgccccttactttatacagtgtggctggtgccacaatcaatgtgtgcgttttgatgaatgccccagcggtacatggactcaagagatctgtctgccggcggtttataaggtgttccccaccagcgcgccccttgaaggaggaacagtgttgaccatatgtggctgggactttggattcaggaagaataataaatttgatttaaggaaaaccaaagttctgcttggcaacgagagctgtaccttgaccttaagcgagagcacgacaaatacgttgaaatgcacagttggtcccgcgatgagtgagcacttcaatgtgtctgtaattatctcaaacagtcgagagacgacgcaatacagtgcattctcctatgtagatcctgtaataacaagcatttctccgaggtacggccctcaggctggaggcaccttactcactcttactgggaaatacctcaacagtggcaattctagacacatttcaattggagggaaaacatgtactttaaaaagtgtatcagatagtattcttgaatgctacaccccagcccaaactacctctgatgagtttcctgtgaaattgaagattgacttggctaaccgagagaccagcagcttcagttaccgggaagaccccgttgtctatgaaatccacccgaccaaatcttttattagtggtggaagcacaataacgggtattgggaagaccctgaactcggttagcctcccaaagctggtaatagatgtgcatgaagtgggtgtgaactacacagtggcatgtcagcatcgctcaaattcagagatcatctgctgcactactccttcactgaaacagctgggcctgcaactccccctgaagaccaaagccttcttcctgttagacgggattctttccaaacactttgatctcacttatgtgcataatcctgtgtttgagccttttgaaaagccagtaatgatctcaataggcaatgaaaatgtagtggaaattaagggaaacaatattgaccctgaagcagttaaaggtgaagtgttaaaagttggaaatcagagctgcgagagtctccactggcactctggagctgtgttgtgtacagtccccagtgacctgctcaaactgaacagcgagctaaatatagagtggaagcaagcagtctcttcaactgttcttggaaaagtgatcgttcaaccggatcagaattttgcaggattgatcattggtgcggtctcaatatcagtagtagttttgttattatccgggctcttcctgtggatgagaaagagaaagcataaagatctgggcagtgaattagttcgctatgacgcaagagtacacactcctcatttggataggcttgtaagtgcccgaagtgtaagtccaactacagagatggtttcaaatgagtctgtagactacagagctacttttccagaagaccagtttcccaactcctctcagaatggagcatgcagacaagtgcaataccctctgacagacctgtcccctatcctgacaagtggagactctgatatatccagcccattactacaaaatactgttcacattgacctcagtgctctaaatccagagctggtccaagcagttcagcacgtagtgattggacccagcagcctgattgtgcatttcaatgaagtcataggaagagggcattttggctgtgtctatcatgggactttgctggacaatgacggaaagaaaattcactgtgctgtgaaatccttaaatagaatcacagatatagaagaggtctcccagtttctgactgagggaatcatcatgaaagacttcagccatcccaatgttctctcactcttgggaatctgcctgaggagtgaagggtctcctctggtggtcctgccctatatgaagcatggagatctgcgaaatttcattcgaaacgagactcataatccaactgtgaaagatcttataggatttggccttcaagtagccaaaggcatgaaatatcttgccagcaaaaagtttgtccacagagacttagctgcaagaaactgcatgttggatgaaaaattcactgtcaaggttgctgatttcggtcttgccagagacatgtacgataaagagtactatagtgtccacaacaagacgggtgccaagctaccagtaaagtggatggctttagagagtctgcaaacgcagaagttcaccaccaagtcagatgtgtggtcctttggtgtgctcctctgggagctcatgacgagaggagcccctccttatcccgacgtgaacacatttgatatcactatctacctgttgcaaggcagaagactcttgcaaccagaatactgtccagacgccttgtacgaagtgatgctaaaatgctggcaccccaaagcggaaatgcgcccgtccttttccgaactggtctccaggatatcctcaatcttctccacgttcattggggaacactacgtccacgtgaacgctacttatgtgaatgtaaaatgtgttgctccatatccttctctgttgccatcccaagacaacattgatggcgaggggaacacatga

SEQ ID NO: 395 - protein, 1383 aa, Artificial Sequence
  mutated murine C-MET antigen
MGWSCIILFLVATATGVHSDYKDDDDKECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTREEVFNILQAAYVSKPGANLAKQIGASPSDDILFGVFAQSKPDSAEPVNRSAVCAFPIKYVNDFFNKIVNKNNVRCLQHFYGPNHEHCFNRTLLRNSSGCEARSDEYRTEFTTALQRVDLFMGRLNQVLLTSISTFIKGDLTIANLGTSEGRFMQVVLSRTAHLTPHVNFLLDSHPVSPEVIVEHPSNQNGYTLVVTGKKITKIPLNGLGCGHFQSCSQCLSAPYFIQCGWCHNQCVRFDECPSGTWTQEICLPAVYKVFPTSAPLEGGTVLTICGWDFGFRKNNKFDLRKTKVLLGNESCTLTLSESTTNTLKCTVGPAMSEHFNVSVIISNSRETTQYSAFSYVDPVITSISPRYGPQAGGTLLTLTGKYLNSGNSRHISIGGKTCTLKSVSDSILECYTPAQTTSDEFPVKLKIDLANRETSSFSYREDPVVYEIHPTKSFISGGSTITGIGKTLNSVSLPKLVIDVHEVGVNYTVACQHRSNSEIICCTTPSLKQLGLQLPLKTKAFFLLDGILSKHFDLTYVHNPVFEPFEKPVMISIGNENVVEIKGNNIDPEAVKGEVLKVGNQSCESLHWHSGAVLCTVPSDLLKLNSELNIEWKQAVSSTVLGKVIVQPDQNFAGLIIGAVSISVVVLLLSGLFLWMRKRKHKDLGSELVRYDARVHTPHLDRLVSARSVSPTTEMVSNESVDYRATFPEDQFPNSSQNGACRQVQYPLTDLSPILTSGDSDISSPLLQNTVHIDLSALNPELVQAVQHVVIGPSSLIVHFNEVIGRGHFGCVYHGTLLDNDGKKIHCAVKSLNRITDIEEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITIYLLQGRRLLQPEYCPDALYEVMLKCWHPKAEMRPSFSELVSRISSIFSTFIGEHYVHVNATYVNVKCVAPYPSLLPSQDNIDGEGNT

SEQ ID NO: 396 - DNA, 37 bp, Artificial Sequence
  macaque C-MET forward primer
aggaattcaccatgaaggcccccgctgtgcttgcacc

SEQ ID NO: 397 - DNA, 23 bp, Artificial Sequence
  macaque C-MET reverse primer
ctccagaggcatttccatgtagg

SEQ ID NO: 398 - DNA, 23 bp, Artificial Sequence
  macaque C-MET forward primer
gtccaaagggaaactctagatgc

SEQ ID NO: 399 - DNA, 24 bp, Artificial Sequence
  macaque C-MET reverse primer
ggagacactggatgggagtccagg

SEQ ID NO: 400 - DNA, 24 bp, Artificial Sequence
  macaque C-MET forward primer
catcagagggtcgcttcatgcagg

SEQ ID NO: 401 - DNA, 24 bp, Artificial Sequence
  macaque C-MET reverse primer
gctttggttttcagggggagttgc

SEQ ID NO: 402 - DNA, 28 bp, Artificial Sequence
  macaque C-MET forward primer
atccaaccaaatcttttattagtggtgg

SEQ ID NO: 403 - DNA, 25 bp, Artificial Sequence
  macaque C-MET reverse primer
gacttcattgaaatgcacaatcagg

SEQ ID NO: 404 - DNA, 23 bp, Artificial Sequence
  macaque C-MET forward primer
tgctctaaatccagagctggtcc

SEQ ID NO: 405 - DNA, 26 bp, Artificial Sequence
  macaque C-MET reverse primer
gtcagataagaaattccttagaatcc

SEQ ID NO: 406 - DNA, 4146 bp, Artificial Sequence
  macaque C-MET
atgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacagccatccagaatgtcattctacatgagcatcacattttcctcggtgccaccaactacatttatgttttaaatgaggaagaccttcagaaggttgctgagtacaagaccgggcctgtgctggaacacccagattgtttcccgtgtcaggactgcagcagcaaagccaatttatcaggaggcgtttggaaagataacatcaacatggctctggttgtggacacctactatgatgatcaactcattagctgtggcagcgtcaacagagggacctgccagcgacatgtctttccccataatcatactgctgacatacagtcggaggttcactgcatattctccccacagatagaagagcccaaccagtgccctgactgtgtggtgagcgccctgggagccaaagtcctttcatctgtaaaggaccggttcatcaacttctttgtaggcaataccataaattcttcttatttcccacatcatccgttgcattcgatatcagtgagaaggctaaaggaaacgaaagatggttttatgtttttgacagaccagtcctacattgatgttttacctgagttcagagattcttaccccattaagtacatccacgcttttgaaagcaacaattttatttacttcttgacggtccaaagggaaactctaaatgctcagacttttcacacaagaataatcaggttctgttccttaaactctggattgcactcctacatggaaatgcctctagagtgtattctcacagaaaagagaaaaaagagatccacaaagaaggaagtgtttaatatccttcaggctgcatatgtcagcaagcccggggcccagcttgctagacaaataggagccagcctgaatgatgacattctctttggggtgttcgcacaaagcaagccagattctgccgaaccaatggatcgatctgcaatgtgtgcatttcctatcaaatatgtcaacgacttcttcaacaagatcgtcaacaaaaacaatgtgagatgtctccagcatttttatggacccaatcatgagcactgttttaataggacacttctgagaaattcatcaggctgtgaagcgcgccgtgatgaatatcgagcagagtttaccacagctttgcagcgggttgacttattcatgggtcaattcagcgaagtcctcttaacatctatatccaccttcgtgaaaggagacctcaccatcgctaatcttgggacatcagagggtcgcttcatgcaggttgtggtttctcgatcaggaccatcaacccctcatgtgaattttctcctggactctcacccggtgtctccagaagtgattgtggagcatccattaaaccagaatggctacacactggttgtcacggggaagaagatcaccaagatcccattgaatggcttgggctgcagacatttccagtcctgcagtcagtgcctctctgccccaccctttgtgcagtgtggctggtgccacgacaaatgtgtgcgatcggaggaatgccccagtgggacatggactcaacagatctgtctgcctgcaatctacaaggttttcccaactagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataaacatttcaatatgtccataattatttcaaatggccacgggacaacacaatacagtacattttcctatgtggatcctataataacaagtatttcgccaaaatatggccctatggctggtggcactttacttactttaactggaaattacctaaacagtggcaattctagacacatttcaattggtggaaaaacatgtactttaaaaagtgtgtcaaacagtattctcgaatgttataccccagcccaaaccatttcaactgagtttgctgttaaattgaaaattgacttagccaaccgagagacaagcatcttcagttaccgggaagaccccattgtctatgaaattcatccaaccaaatcttttattagtggtgggagcacaataacaggtgttgggaaaaacctgcattcagttagtgtcccgaggatggtcataaatgtgcatgaagcaggaaggaactttacagtggcatgtcagcatcgctctaattcagagataatctgctgtaccactccttccctgcaacagctgaatctgcaactccccctgaaaaccaaagcctttttcatgttagatgggatcctttccaaatactttgatctcatttatgtacataatcctgtgtttaagccttttgaaaagccagtaatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcaccggattgattgctggtgttgtctcaatatcaatagcactcttactactacttgggcttttcctgtggctgaaaaagagaaagcaaattaaagatctgggcagtgaattagttcgctatgatgcaagagtacacactcctcatttggataggcttgtaagtgcccgaagtgtaagcccaacaacagaaatggtttcaaatgaatctgtagactaccgagctacttttccagaagatcagtttcctaattcatctcagaacggttcatgccgacaagtgcagtatcctctgacagacatgtcccccatcctgactagtggggactctgatatatccagtccattactgcaaaacactgtccacattgacctcagcgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccagtttctgaccgagggaatcatcatgaaagattttagtcatcccaatgtcctctcgctcctgggaatctgcctgcgaagtgaagggtctccgctggtggtcctaccctacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtgcacaacaaaacaggtgcaaagctgccagtgaagtggatggctttggaaagtctgcaaactcaaaagtttaccaccaagtcagatgtgtggtcctttggtgtgctcctctgggagctcatgacaagaggagccccaccctatcctgatgtgaacacctttgatataactgtttacttgttgcaagggagaaggctcctacaacccgaatactgcccagaccccttatatgaagtaatgctaaaatgctggcaccctaaagcagaaatgcgcccatccttttctgaactggtgtcccggatatcagcgatcttctctactttcattggggagcactacgtccatgtaaacgctacttatgtgaacgtaaaatgtgtcgctccatatccttctctgttgtcatcagaagataacgctgatgacgaggtggacacatga

SEQ ID NO: 407 - protein, 1381 aa, Artificial Sequence
  macaque C-MET
MKAPAVLAPGILVLLFTLVQRSNGECKEALAKSEMNVNMKYQLPNFTAETAIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPNQCPDCVVSALGAKVLSSVKDRFINFFVGNTINSSYFPHHPLHSISVRRLKETKDGFMFLTDQSYIDVLPEFRDSYPIKYIHAFESNNFIYFLTVQRETLNAQTFHTRIIRFCSLNSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRAEFTTALQRVDLFMGQFSEVLLTSISTFVKGDLTIANLGTSEGRFMQVVVSRSGPSTPHVNFLLDSHPVSPEVIVEHPLNQNGYTLVVTGKKITKIPLNGLGCRHFQSCSQCLSAPPFVQCGWCHDKCVRSEECPSGTWTQQICLPAIYKVFPTSAPLEGGTRLTICGWDFGFRRNNKFDLKKTRVLLGNESCTLTLSESTMNTLKCTVGPAMNKHFNMSIIISNGHGTTQYSTFSYVDPIITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLHSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISIALLLLLGLFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDT

SEQ ID NO: 408 - DNA, 2298 bp, Artificial Sequence
  human Endosialin construct
atgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtggactacaaagatgatgacgataagtga

SEQ ID NO: 409 - protein, 765 aa, Artificial Sequence
  human Endosialin construct
MLLRLLLAWAAAGPTLGQDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWLLVALLVPTCVFLVVLLALGIVYCTRCGPHAPNKRITDCYRWVIHAGSKSPTEPMPPRGSLTGVQTCRTSVDYKDDDDK

SEQ ID NO: 410 - DNA, 2781 bp, Artificial Sequence
  soluble fusion protein of h Endosialin and m IgG1 Fc
atgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggaccggaggtggtggatccgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgaaaccccgggaggagcagatcaacagcactttccgttcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacaaacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatccgggcatcatcaccatcatcattga

SEQ ID NO: 411 - protein, 926 aa, Artificial Sequence
  soluble fusion protein of h Endosialin and m IgG1 Fc
MLLRLLLAWAAAGPTLGQDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRTGGGGSVPRDCGCKPCICTVPEVSSVFIFPPKPKDVLTITLTPKVTCVVVDISKDDPEVQFSWFVDDVEVHTAQTKPREEQINSTFRSVSELPIMHQDWLNGKEFKCRVNSAAFPAPIEKTISKTKGRPKAPQVYTIPPPKEQMAKDKVSLTCMITNFFPEDITVEWQWNGQPAENYKNTQPIMDTDGSYFVYSKLNVQKSNWEAGNTFTCSVLHEGLHNHHTEKSLSHSPGKSGHHHHHH

SEQ ID NO: 412 - DNA, 2319 bp, Artificial Sequence
  murine Endosialin construct
atgggatggagctgtatcatcctcttcttggtagcaacagctacaggtgtacactccgactacaaagatgatgacgataagtggacgccggagcctcgagccgcgtgcggccccagcagctgctacgcgctctttccccggcgccgcacattcctggaagcttggcgggcgtgccgcgaattggggggcaacctggccacaccgcggaccccagaggaggcccagcgtgtggacagcctggtgggggtcgggccggccaacgggctgctatggattgggttgcagcggcaggctaggcaatgccagccgcagcgcccactgcggggcttcatatggaccacgggagaccaggacaccgccttcaccaactgggcccagccggctacggaaggaccctgcccagcccagcgctgtgcagcccttgaggccagcggagagcatcgctggctcgaaggctcgtgcacactggctgtcgatggctacctctgccagtttggttttgagggtgcctgccctgccttgccgcttgaggtgggtcaggccggtcccgctgtctacaccacacccttcaacctggtttccagcgagttcgaatggctgccctttggctccgtggcagctgtgcagtgccaagctggcaggggagcttctctgctgtgcgtgaaacagccttcaggtggcgtgggctggtcccagactggcccgctgtgcccagggactggctgtggtcctgacaatgggggttgcgaacatgagtgtgtggaagaggtggacggtgctgtgtcctgccgctgcagtgaaggcttccgtctagcagcagatgggcacagttgtgaagacccctgtgcccaggccccctgtgagcagcagtgtgaacctggagggccacaaggctatagctgccactgtcgccttggcttccggccagctgaggatgatccacaccgctgcgtggacacggatgagtgccagattgctggtgtgtgccagcagatgtgtgtcaactatgttggtggctttgagtgttactgcagcgagggtcacgagcttgaggcagatggtatcagctgtagccctgcaggagccatgggtgcccaggcttcccaggatctcagagatgagttgctggatgatggagaagaaggggaggatgaagaggagccctgggaggactttgatggcacctggacagaggaacaggggatcctatggctggcacctacacatccacctgactttggcctgccctataggcccaacttcccacaggatggagagcctcagagattgcacctggagcctacctggccacccccacttagtgcccccaggggcccctaccactcctcagtggtgtctgccacacggcccatggtgatctctgccactcgacccacactaccttctgcccacaagacctctgttatttcagctacacgcccacccctgagccctgtccacccacctgccatggcccctgccacacctccagctgtgttctctgagcaccagatccccaaaatcaaggccaattatccagacctgccttttggccacaagcctgggataacctcggccactcacccagcacggtctcctccgtaccagccccccattatctcaaccaactatccccaagtcttccctccccaccaggcccctatgtctccagatacccacactatcacttatttgcctccagtcccccctcaccttgatcctggggataccacttctaaagcccatcaacaccctttgctcccagatgctccaggtatcagaacccaggccccccagctttctgtctcagctctccagccccctcttcctaccaactccaggtcttctgtccatgaaactcctgtgcctgctgccaaccagcccccagccttcccttcttctcccctcccccctcagaggcccactaaccagacctcatctatcagccctacacattcctattccagagcccctctagtcccaagggaaggagttcccagtcccaaatcagtgccacagctgccctcggtgccctccacagcagctccaacagccctggcagagtcaggtcttgcaggccaaagccaaagggatgaccgctggctgctggtggcactcctggtgccaacatgtgtcttcttggtggtgctgcttgccctgggcattgtgtactgcactcgctgtggctcccacgcacccaacaagcggatcacggactgctatcgctgggtcacacatgctgggaacaagagctcaacagaacccatgccccccagaggcagccttacaggggtacagacctgtagaaccagtgtgtga

SEQ ID NO: 413 - protein, 772 aa, Artificial Sequence
  murine Endosialin construct
MGWSCIILFLVATATGVHSDYKDDDDKWTPEPRAACGPSSCYALFPRRRTFLEAWRACRELGGNLATPRTPEEAQRVDSLVGVGPANGLLWIGLQRQARQCQPQRPLRGFIWTTGDQDTAFTNWAQPATEGPCPAQRCAALEASGEHRWLEGSCTLAVDGYLCQFGFEGACPALPLEVGQAGPAVYTTPFNLVSSEFEWLPFGSVAAVQCQAGRGASLLCVKQPSGGVGWSQTGPLCPGTGCGPDNGGCEHECVEEVDGAVSCRCSEGFRLAADGHSCEDPCAQAPCEQQCEPGGPQGYSCHCRLGFRPAEDDPHRCVDTDECQIAGVCQQMCVNYVGGFECYCSEGHELEADGISCSPAGAMGAQASQDLRDELLDDGEEGEDEEEPWEDFDGTWTEEQGILWLAPTHPPDFGLPYRPNFPQDGEPQRLHLEPTWPPPLSAPRGPYHSSVVSATRPMVISATRPTLPSAHKTSVISATRPPLSPVHPPAMAPATPPAVFSEHQIPKIKANYPDLPFGHKPGITSATHPARSPPYQPPIISTNYPQVFPPHQAPMSPDTHTITYLPPVPPHLDPGDTTSKAHQHPLLPDAPGIRTQAPQLSVSALQPPLPTNSRSSVHETPVPAANQPPAFPSSPLPPQRPTNQTSSISPTHSYSRAPLVPREGVPSPKSVPQLPSVPSTAAPTALAESGLAGQSQRDDRWLLVALLVPTCVFLVVLLALGIVYCTRCGSHAPNKRITDCYRWVTHAGNKSSTEPMPPRGSLTGVQTCRTSV

SEQ ID NO: 414 - DNA, 2295 bp, Artificial Sequence
  mutated human Endosialin antigen
atgggatggagctgtatcatcctcttcttggtagcaacagctacaggtgtacactccgactacaaagatgatgacgataagtggacgccggagcctcgagccgcgtgcggccccagcagctgctacgcgctctttccccggcgccgcacattcctggaagcttggcgggcgtgccgcgaattggggggcaacctggccacaccgcggaccccagaggaggcccagcgtgtggacagcctggtgggggtcgggccggccaacgggctgctatggattgggttgcagcggcaggctaggcaatgccagccgcagcgcccactgcggggcttcatatggaccacgggagaccaggacaccgccttcaccaactgggcccagccggctacggaaggaccctgcccagcccagcgctgtgcagcccttgaggccagcggagagcatcgctggctcgaaggctcgtgcacactggctgtcgatggctacctctgccagtttggttttgagggtgcctgccctgccttgccgcttgaggtgggtcaggccggtccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtga

SEQ ID NO: 415 - protein, 764 aa, Artificial Sequence
  mutated human Endosialin antigen
MGWSCIILFLVATATGVHSDYKDDDDKWTPEPRAACGPSSCYALFPRRRTFLEAWRACRELGGNLATPRTPEEAQRVDSLVGVGPANGLLWIGLQRQARQCQPQRPLRGFIWTTGDQDTAFTNWAQPATEGPCPAQRCAALEASGEHRWLEGSCTLAVDGYLCQFGFEGACPALPLEVGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWLLVALLVPTCVFLVVLLALGIVYCTRCGPHAPNKRITDCYRWVIHAGSKSPTEPMPPRGSLTGVQTCRTSV

SEQ ID NO: 416 - DNA, 2319 bp, Artificial Sequence
  mutated murine Endosialin antigen
atgggatggagctgtatcatcctcttcttggtagcaacagctacaggtgtacactccgactacaaagatgatgacgataagtgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtagacggctacctgtgccagtttggcttcgagggcgcctgcccggcgctgcaagatgaggcgggccaggccggccccgctgtctacaccacacccttcaacctggtttccagcgagttcgaatggctgccctttggctccgtggcagctgtgcagtgccaagctggcaggggagcttctctgctgtgcgtgaaacagccttcaggtggcgtgggctggtcccagactggcccgctgtgcccagggactggctgtggtcctgacaatgggggttgcgaacatgagtgtgtggaagaggtggacggtgctgtgtcctgccgctgcagtgaaggcttccgtctagcagcagatgggcacagttgtgaagacccctgtgcccaggccccctgtgagcagcagtgtgaacctggagggccacaaggctatagctgccactgtcgccttggcttccggccagctgaggatgatccacaccgctgcgtggacacggatgagtgccagattgctggtgtgtgccagcagatgtgtgtcaactatgttggtggctttgagtgttactgcagcgagggtcacgagcttgaggcagatggtatcagctgtagccctgcaggagccatgggtgcccaggcttcccaggatctcagagatgagttgctggatgatggagaagaaggggaggatgaagaggagccctgggaggactttgatggcacctggacagaggaacaggggatcctatggctggcacctacacatccacctgactttggcctgccctataggcccaacttcccacaggatggagagcctcagagattgcacctggagcctacctggccacccccacttagtgcccccaggggcccctaccactcctcagtggtgtctgccacacggcccatggtgatctctgccactcgacccacactaccttctgcccacaagacctctgttatttcagctacacgcccacccctgagccctgtccacccacctgccatggcccctgccacacctccagctgtgttctctgagcaccagatccccaaaatcaaggccaattatccagacctgccttttggccacaagcctgggataacctcggccactcacccagcacggtctcctccgtaccagccccccattatctcaaccaactatccccaagtcttccctccccaccaggcccctatgtctccagatacccacactatcacttatttgcctccagtcccccctcaccttgatcctggggataccacttctaaagcccatcaacaccctttgctcccagatgctccaggtatcagaacccaggccccccagctttctgtctcagctctccagccccctcttcctaccaactccaggtcttctgtccatgaaactcctgtgcctgctgccaaccagcccccagccttcccttcttctcccctcccccctcagaggcccactaaccagacctcatctatcagccctacacattcctattccagagcccctctagtcccaagggaaggagttcccagtcccaaatcagtgccacagctgccctcggtgccctccacagcagctccaacagccctggcagagtcaggtcttgcaggccaaagccaaagggatgaccgctggctgctggtggcactcctggtgccaacatgtgtcttcttggtggtgctgcttgccctgggcattgtgtactgcactcgctgtggctcccacgcacccaacaagcggatcacggactgctatcgctgggtcacacatgctgggaacaagagctcaacagaacccatgccccccagaggcagccttacaggggtacagacctgtagaaccagtgtgtag

SEQ ID NO: 417 - protein, 772 aa, Artificial Sequence
  mutated murine Endosialin antigen
MGWSCIILFLVATATGVHSDYKDDDDKWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFNLVSSEFEWLPFGSVAAVQCQAGRGASLLCVKQPSGGVGWSQTGPLCPGTGCGPDNGGCEHECVEEVDGAVSCRCSEGFRLAADGHSCEDPCAQAPCEQQCEPGGPQGYSCHCRLGFRPAEDDPHRCVDTDECQIAGVCQQMCVNYVGGFECYCSEGHELEADGISCSPAGAMGAQASQDLRDELLDDGEEGEDEEEPWEDFDGTWTEEQGILWLAPTHPPDFGLPYRPNFPQDGEPQRLHLEPTWPPPLSAPRGPYHSSVVSATRPMVISATRPTLPSAHKTSVISATRPPLSPVHPPAMAPATPPAVFSEHQIPKIKANYPDLPFGHKPGITSATHPARSPPYQPPIISTNYPQVFPPHQAPMSPDTHTITYLPPVPPHLDPGDTTSKAHQHPLLPDAPGIRTQAPQLSVSALQPPLPTNSRSSVHETPVPAANQPPAFPSSPLPPQRPTNQTSSISPTHSYSRAPLVPREGVPSPKSVPQLPSVPSTAAPTALAESGLAGQSQRDDRWLLVALLVPTCVFLVVLLALGIVYCTRCGSHAPNKRITDCYRWVTHAGNKSSTEPMPPRGSLTGVQTCRTSV

SEQ ID NO: 418 - DNA, 40 bp, Artificial Sequence
  macaque Endosialin forward primer
atatgaattcgccaccatgctgctgcgcctgttgctggcc

SEQ ID NO: 419 - DNA, 24 bp, Artificial Sequence
  macaque Endosialin reverse primer
gtcttcatcttcctcatcctcccc

SEQ ID NO: 420 - DNA, 26 bp, Artificial Sequence
  macaque Endosialin forward primer
gtcaactacgttggtggcttcgagtg

SEQ ID NO: 421 - DNA, 57 bp, Artificial Sequence
  macaque Endosialin reverse primer
ggtctagatcacttatcgtcatcatctttgtagtccacgctggttctgcaggtctgc

SEQ ID NO: 422 - DNA, 2298 bp, Artificial Sequence
  macaque Endosialin
atgctgctgcgcctgttgctggcctgggcggccgcagggcccacactgggccaggacccctgggctgctgagccccgctccgcctgcggccccagcagctgctacgctctctttccacggcgccgcacctttctggaggcctggcgggcctgccgcgagctggggggcgacctggccactcctcggacccccgaggaggcccagcgtgtggacaacctggtgggtgcaggcccggccagccggctgctgtggatcggcctgcagcggcaggcccggcaatgccagctgcagcgcccactgcgaggcttcacgtggaccacaggggaccaggacacggctttcaccaactgggcccagccagccactggaggcccctgcccggcccagcgctgtgtggccctggaggcgagtggcgagcaccgctggctggagggctcatgcacgctggctgtcgacggctacttgtgccagtttggcttcgagggtgcctgcccagcgctgcaagacgaagcgggccaggccggcccagccgtctataccacgcccttccacctggtctccacagagtttgagtggctacccttcggctctgtggccgctgtgcagtgccaggctggcaggggagcctctctgctctgcgtgaagcagcccgagggaggtgtgggctggtcacgggcagggcccctgtgcctgggggctggctgcagccctgacaacgggggctgcgaacacgaatgtgtggaggaggtggatggtcacgtgtcctgccgctgcactgagggcttccggctggcagcagacgggcgcagttgcgaggatccctgtgcccaggctccatgcgagcagcagtgtgagcccggtgggccacaaggctacagctgccactgtcgcctgggtttccgacctgcagaggatgatccgcaccgctgtgtggacacagatgagtgccagattgccggtgtgtgccagcagatgtgtgtcaactacgttggtggcttcgagtgttattgtagtgagggtcatgagctggaggctgatggcatcagctgcagccctgcaggggccatgggtgcccgggcttcccaggacctcggagatgagttgctggatgatggggaggatgaggaagatgaagacgaggcctgggaggcctttggcggtggctggacggagatgcctgggatcctgtggatggagcctactcagccgcctgactttgccctggcctatagaccgagcttcccagaggacagagagccacagataccctacccggagcccacctggccgcccccgctcagtgcccccagggtcccctaccactcctcagtgctctccgtcacccggcctgtggtggtctctgccacgcgccccacactgccttccgcccaccagcctcctgtgatccctgccacacacccagctttgtcccgtgaccaccagatccccgtgatcgcagccaactatccagatctgccttctgcctaccaacccggtattctctctgtctctcatccagcacagccccctgcccaccagccccccatgatctcaaccagatatcctgagctgttccctgcccaccagtcccccatgtttccagacacccaggtcgctggcacccagaccaccactcatttgcctgcaatcccacctaaccgtgcccctctggtcaccacactcggtgcccatcaaccccctcaagccccagatgcccctgtcctcagaacccaggctacccagcttcccattatccctactgcccagccgtctctgaccaccagctccaggtcccctgtgtctcctgcccatcaagtctctgtgcctgctgccacccagcccccagccctccccaccctcctgccctctcagagccccactaaccagacctcacccatcagccctacacatccccattccaaagtcccccaaatcccaagggaagatggccccagtcccaagctggccctgtggctgccctcagcagctcccacagcagccccaacagccctgggggaggctagtcttgccgagcacatccagagggatgaccggtggcttctggtggcactcctcgtgccaacgtgtgtctttttggtggtcctgcttgcactgggcattgtgtactgcacccgctgtggcccccatgcacccaacaagcgcatcactgactgctatcgctgggtcacccatgctgggagcaagagtccaacagaacccatgccccccaggggcagcctcacaggggtgcagacctgcagaaccagcgtggactacaaagatgatgacgataagtga

SEQ ID NO: 423 - protein, 765 aa, Artificial Sequence
  macaque Endosialin
MLLRLLLAWAAAGPTLGQDPWAAEPRSACGPSSCYALFPRRRTFLEAWRACRELGGDLATPRTPEEAQRVDNLVGAGPASRLLWIGLQRQARQCQLQRPLRGFTWTTGDQDTAFTNWAQPATGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGAGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGARASQDLGDELLDDGEDEEDEDEAWEAFGGGWTEMPGILWMEPTQPPDFALAYRPSFPEDREPQIPYPEPTWPPPLSAPRVPYHSSVLSVTRPVVVSATRPTLPSAHQPPVIPATHPALSRDHQIPVIAANYPDLPSAYQPGILSVSHPAQPPAHQPPMISTRYPELFPAHQSPMFPDTQVAGTQTTTHLPAIPPNRAPLVTTLGAHQPPQAPDAPVLRTQATQLPIIPTAQPSLTTSSRSPVSPAHQVSVPAATQPPALPTLLPSQSPTNQTSPISPTHPHSKVPQIPREDGPSPKLALWLPSAAPTAAPTALGEASLAEHIQRDDRWLLVALLVPTCVFLVVLLALGIVYCTRCGPHAPNKRITDCYRWVTHAGSKSPTEPMPPRGSLTGVQTCRTSVDYKDDDDK

SEQ ID NO: 424 - DNA, 4104 bp, Artificial Sequence
  human IGF-R1 construct
atgaagtctggctccggcggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctga

SEQ ID NO: 425 - protein, 1367 aa, Artificial Sequence
  human IGF-R1 construct
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 426 - DNA, 3531 bp, Artificial Sequence
  soluble fusion protein of h IGF-R1 and m IgG1 Fc
atgaagtctggctccggcggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccattccggaggtggtggatccgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgaaaccccgggaggagcagatcaacagcactttccgttcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacaaacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatccgggcatcatcaccatcatcattga

SEQ ID NO: 427 - protein, 1176 aa, Artificial Sequence
  soluble fusion protein of h IGF-R1 and m IgG1 Fc
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHSGGGGSVPRDCGCKPCICTVPEVSSVFIFPPKPKDVLTITLTPKVTCVVVDISKDDPEVQFSWFVDDVEVHTAQTKPREEQINSTFRSVSELPIMHQDWLNGKEFKCRVNSAAFPAPIEKTISKTKGRPKAPQVYTIPPPKEQMAKDKVSLTCMITNFFPEDITVEWQWNGQPAENYKNTQPIMDTDGSYFVYSKLNVQKSNWEAGNTFTCSVLHEGLHNHHTEKSLSHSPGKSGHHHHHH

SEQ ID NO: 428 - DNA, 4101 bp, Artificial Sequence
  murine IGF-R1 construct
atgggatggagctgtatcatcctcttcttggtagcaacagctacaggtgtacactccgattacaaggacgacgatgacaaggaaatctgtgggcccggcattgacatccgcaacgactatcagcagctgaagcgcctggaaaactgcacggtgatcgagggcttcctccacatcctgctcatctccaaggccgaggactaccgaagctaccgcttccccaagctcaccgtcatcactgagtacttgctgctcttccgagtcgctggcctcgagagcctgggagacctcttccccaacctcacagtcatccgtggctggaaactcttctacaactacgcactggtcatcttcgagatgaccaatctcaaggatattgggctttataatctgaggaacattactcggggggccatcaggattgagaagaacgccgacctctgttacctctccaccatagactggtctctcatcttggatgcggtgtccaataactacattgtggggaacaagcccccgaaggaatgtggggacctgtgtccagggacattggaggagaagcccatgtgtgagaagaccaccatcaacaatgagtacaactaccgctgctggaccacaaatcgctgccagaaaatgtgcccaagtgtgtgcgggaagcgagcctgcaccgagaacaacgagtgctgccacccggagtgcctgggcagctgccacacaccggacgacaacacaacctgcgtggcctgcagacactactactacaaaggcgtgtgtgtgcctgcctgcccgcctggcacctacaggttcgagggctggcgctgtgtggatcgcgatttctgcgccaacatccccaacgctgagagcagtgactcggatggcttcgttatccacgacgatgagtgcatgcaggagtgtccctcaggcttcatccgcaacagcacccagagcatgtactgtatcccctgcgaaggcccctgccccaaagtctgcggcgatgaagagaagaaaacgaaaaccatcgattcggtgacttctgctcaaatgctccaaggatgcaccatcctgaagggcaatctgcttattaacatccggagaggcaataacattgcctcggagttggagaacttcatggggctcatcgaggtggtgaccggctacgtgaagatccgccattctcatgccttggtctccttgtccttcctgaagaaccttcgtctcatcttaggagaggagcagctggaagggaactactccttctatgtcctagacaaccagaacttgcagcagctgtgggactggaaccaccggaacctgaccgtcaggtccggaaagatgtactttgctttcaatcccaagctgtgtgtctccgaaatttaccgcatggaggaagtgaccggaaccaagggacgccagagcaaaggggacataaacaccaggaacaacggagagcgagcttcctgtgaaagtgatgttctccgtttcacctccaccacgacctggaagaaccgaatcatcataacgtggcaccggtaccggccgccggactaccgggatctcatcagcttcacagtttactacaaggaggcaccatttaaaaacgttacggaatatgacgggcaggatgcctgtggctccaacagctggaacatggtggatgtagacctgcctccgaacaaggagggcgagcctggcattttactgcatgggctgaagccctggacccagtatgctgtctatgtcaaggctgtgaccctcaccatggtggaaaacgaccatatccgtggggccaaaagtgaaatcttgtacattcgcaccaatgcttcagtcccttccattcccctagatgtcctctcagcatcaaactcttcctctcagctgattgtgaagtggaatcctccaactctgcccaatggtaacttgagttactacattgtgaggtggcagcggcagccccaggatggttacctgtaccggcacaactactgctccaaagacaaaatacccatcagaaagtacgccgatggtaccatcgacgtggaggaggtgacggaaaatcccaagacagaagtgtgtggtggtgataaagggccatgctgcgcttgccctaaaactgaagctgagaagcaggctgagaaggaggaggctgagtaccgtaaagtctttgagaatttccttcacaattccatctttgtgcccaggcccgaaaggaggcggagagacgtcatgcaagtggccaacacgaccatgtccagccgaagcaggaacaccacggtagctgacacctacaatatcacagacccggaggagttcgagacagagtaccctttctttgagagcagagtggataacaaggagaggactgtcatctccaacctccggcctttcactctgtaccgcatcgatatccacagctgcaaccacgaggctgagaagctgggctgcagcgcctccaacttcgtctttgcgagaaccatgccagcagaaggagcagatgatatccctggtccggtgacctgggagccaagacccgaaaactccatctttttaaagtggccagaacccgagaaccccaacggattgatcctaatgtatgaaattaaatacgggtcgcaagtcgaggatcagcgggaatgtgtgtccagacaggagtacaggaagtacggaggggccaaactcaaccgtctaaacccagggaactatacagcccggattcaggctacctccctctctgggaatgggtcatggacagatcctgtgttcttctatgtccccgccaaaacgacgtatgagaacttcatgcatctgatcattgctctgccggttgccatcctgctgatcgttggggggctggttatcatgctgtatgtcttccatagaaagagaaataacagcaggttgggcaatggagtgctgtatgcttctgtgaaccccgagtatttcagcgcagctgatgtgtacgtgcctgatgaatgggaggtagctcgagagaagatcaccatgaaccgggagctcggacaagggtcctttgggatggtctatgaaggagtggccaagggtgtggtcaaggatgaacccgaaaccagagtggccatcaagacggtaaacgaggctgcaagtatgcgtgaaagaatcgagtttctcaacgaggcctcggtgatgaaggagttcaattgtcaccatgtggtccggttgctgggtgtggtatcccaaggccagcccaccctggtcatcatggaactaatgacacgcggtgatctcaaaagttatctccggtctctgaggccagaagtggagcagaataatctagtcctcattcctccgagcttaagcaagatgatccagatggctggagagattgcagatggcatggcctacctcaatgccaacaagttcgtccacagagaccttgctgctaggaactgcatggtagccgaagatttcacagtcaaaattggagatttcggtatgacacgagacatctacgagacggactactaccggaaaggcgggaaggggttgctgcctgtgcgctggatgtctcccgagtccctcaaggatggtgtcttcactactcattctgatgtctggtccttcggggtcgtcctctgggagatcgccacgctggctgagcagccctaccagggcttgtccaacgagcaagttcttcgtttcgtcatggagggtggccttctggacaagccggacaactgccctgatatgctgtttgaacttatgcgcatgtgctggcagtataaccccaagatgcggccctccttcctggagatcatcggcagcatcaaggatgagatggagcccagcttccaggaggtctccttctactacagcgaggagaacaagcctcccgagccagaggagctggagatggagcctgagaacatggagagcgtcccactggacccttcggcctcctcagcctccctgcctctgcctgaaagacactcaggacacaaggctgagaatggcccgggccctggcgtgctcgttctccgcgccagttttgatgagagacagccttacgctcacatgaacgggggacgcgccaacgagagggccttgcctctgccccagtcctcgacctgctga

SEQ ID NO: 429 - protein, 1366 aa, Artificial Sequence
  murine IGF-R1 construct
MGWSCIILFLVATATGVHSDYKDDDDKEICGPGIDIRNDYQQLKRLENCTVIEGFLHILLISKAEDYRSYRFPKLTVITEYLLLFRVAGLESLGDLFPNLTVIRGWKLFYNYALVIFEMTNLKDIGLYNLRNITRGAIRIEKNADLCYLSTIDWSLILDAVSNNYIVGNKPPKECGDLCPGTLEEKPMCEKTTINNEYNYRCWTTNRCQKMCPSVCGKRACTENNECCHPECLGSCHTPDDNTTCVACRHYYYKGVCVPACPPGTYRFEGWRCVDRDFCANIPNAESSDSDGFVIHDDECMQECPSGFIRNSTQSMYCIPCEGPCPKVCGDEEKKTKTIDSVTSAQMLQGCTILKGNLLINIRRGNNIASELENFMGLIEVVTGYVKIRHSHALVSLSFLKNLRLILGEEQLEGNYSFYVLDNQNLQQLWDWNHRNLTVRSGKMYFAFNPKLCVSEIYRMEEVTGTKGRQSKGDINTRNNGERASCESDVLRFTSTTTWKNRIIITWHRYRPPDYRDLISFTVYYKEAPFKNVTEYDGQDACGSNSWNMVDVDLPPNKEGEPGILLHGLKPWTQYAVYVKAVTLTMVENDHIRGAKSEILYIRTNASVPSIPLDVLSASNSSSQLIVKWNPPTLPNGNLSYYIVRWQRQPQDGYLYRHNYCSKDKIPIRKYADGTIDVEEVTENPKTEVCGGDKGPCCACPKTEAEKQAEKEEAEYRKVFENFLHNSIFVPRPERRRRDVMQVANTTMSSRSRNTTVADTYNITDPEEFETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVPAKTTYENFMHLIIALPVAILLIVGGLVIMLYVFHRKRNNSRLGNGVLYASVNPEYFSAADVYVPDEWEVAREKITMNRELGQGSFGMVYEGVAKGVVKDEPETRVAIKTVNEAASMRERIEFLNEASVMKEFNCHHVVRLLGVVSQGQPTLVIMELMTRGDLKSYLRSLRPEVEQNNLVLIPPSLSKMIQMAGEIADGMAYLNANKFVHRDLAARNCMVAEDFTVKIGDFGMTRDIYETDYYRKGGKGLLPVRWMSPESLKDGVFTTHSDVWSFGVVLWEIATLAEQPYQGLSNEQVLRFVMEGGLLDKPDNCPDMLFELMRMCWQYNPKMRPSFLEIIGSIKDEMEPSFQEVSFYYSEENKPPEPEELEMEPENMESVPLDPSASSASLPLPERHSGHKAENGPGPGVLVLRASFDERQPYAHMNGGRANERALPLPQSSTC

SEQ ID NO: 430 - DNA, 4095 bp, Artificial Sequence
  mutated human IGF-R1 antigen
atgggatggagctgtatcatcctcttcttggtagcaacagctacaggtgtacactccgattacaaggacgacgatgacaaggaaatctgtgggcccggcattgacatccgcaacgactatcagcagctgaagcgcctggaaaactgcacggtgatcgagggcttcctccacatcctgctcatctccaaggccgaggactaccgaagctaccgcttccccaagctcaccgtcatcactgagtacttgctgctcttccgagtcgctggcctcgagagcctgggagacctcttccccaacctcacagtcatccgtggctggaaactcttctacaactacgcactggtcatcttcgagatgaccaatctcaaggatattgggctttataatctgaggaacattactcggggggccatcaggattgagaagaacgccgacctctgttacctctccaccatagactggtctctcatcttggatgcggtgtccaataactacattgtggggaacaagcccccgaaggaatgtggggacctgtgtccagggacattggaggagaagcccatgtgtgagaagaccaccatcaacaatgagtacaactaccgctgctggaccacaaatcgctgccagaaaatgtgcccaagtgtgtgcgggaagcgagcctgcaccgagaacaacgagtgctgccacccggagtgcctgggcagctgccacacaccggacgacaacacaacctgcgtggcctgcagacactactactacaaaggcgtgtgtgtgcctgcctgcccgcctggcacctacaggttcgagggctggcgctgtgtggatcgcgatttctgcgccaacatccccaacgctgagagcagtgactcggatggcttcgttatccacgacgatgagtgcatgcaggagtgtccctcaggcttcatccgcaacagcacccagagcatgtactgtatcccctgcgaaggcccctgccccaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctga

SEQ ID NO: 431 - protein, 1364 aa, Artificial Sequence
  mutated human IGF-R1 antigen
MGWSCIILFLVATATGVHSDYKDDDDKEICGPGIDIRNDYQQLKRLENCTVIEGFLHILLISKAEDYRSYRFPKLTVITEYLLLFRVAGLESLGDLFPNLTVIRGWKLFYNYALVIFEMTNLKDIGLYNLRNITRGAIRIEKNADLCYLSTIDWSLILDAVSNNYIVGNKPPKECGDLCPGTLEEKPMCEKTTINNEYNYRCWTTNRCQKMCPSVCGKRACTENNECCHPECLGSCHTPDDNTTCVACRHYYYKGVCVPACPPGTYRFEGWRCVDRDFCANIPNAESSDSDGFVIHDDECMQECPSGFIRNSTQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 432 - DNA, 4101 bp, Artificial Sequence
  mutated murine IGF-R1 antigen
atgggatggagctgtatcatcctcttcttggtagcaacagctacaggtgtacactccgattacaaggacgacgatgacaaggaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaagtctgcggcgatgaagagaagaaaacgaaaaccatcgattcggtgacttctgctcaaatgctccaaggatgcaccatcctgaagggcaatctgcttattaacatccggagaggcaataacattgcctcggagttggagaacttcatggggctcatcgaggtggtgaccggctacgtgaagatccgccattctcatgccttggtctccttgtccttcctgaagaaccttcgtctcatcttaggagaggagcagctggaagggaactactccttctatgtcctagacaaccagaacttgcagcagctgtgggactggaaccaccggaacctgaccgtcaggtccggaaagatgtactttgctttcaatcccaagctgtgtgtctccgaaatttaccgcatggaggaagtgaccggaaccaagggacgccagagcaaaggggacataaacaccaggaacaacggagagcgagcttcctgtgaaagtgatgttctccgtttcacctccaccacgacctggaagaaccgaatcatcataacgtggcaccggtaccggccgccggactaccgggatctcatcagcttcacagtttactacaaggaggcaccatttaaaaacgttacggaatatgacgggcaggatgcctgtggctccaacagctggaacatggtggatgtagacctgcctccgaacaaggagggcgagcctggcattttactgcatgggctgaagccctggacccagtatgctgtctatgtcaaggctgtgaccctcaccatggtggaaaacgaccatatccgtggggccaaaagtgaaatcttgtacattcgcaccaatgcttcagtcccttccattcccctagatgtcctctcagcatcaaactcttcctctcagctgattgtgaagtggaatcctccaactctgcccaatggtaacttgagttactacattgtgaggtggcagcggcagccccaggatggttacctgtaccggcacaactactgctccaaagacaaaatacccatcagaaagtacgccgatggtaccatcgacgtggaggaggtgacggaaaatcccaagacagaagtgtgtggtggtgataaagggccatgctgcgcttgccctaaaactgaagctgagaagcaggctgagaaggaggaggctgagtaccgtaaagtctttgagaatttccttcacaattccatctttgtgcccaggcccgaaaggaggcggagagacgtcatgcaagtggccaacacgaccatgtccagccgaagcaggaacaccacggtagctgacacctacaatatcacagacccggaggagttcgagacagagtaccctttctttgagagcagagtggataacaaggagaggactgtcatctccaacctccggcctttcactctgtaccgcatcgatatccacagctgcaaccacgaggctgagaagctgggctgcagcgcctccaacttcgtctttgcgagaaccatgccagcagaaggagcagatgatatccctggtccggtgacctgggagccaagacccgaaaactccatctttttaaagtggccagaacccgagaaccccaacggattgatcctaatgtatgaaattaaatacgggtcgcaagtcgaggatcagcgggaatgtgtgtccagacaggagtacaggaagtacggaggggccaaactcaaccgtctaaacccagggaactatacagcccggattcaggctacctccctctctgggaatgggtcatggacagatcctgtgttcttctatgtccccgccaaaacgacgtatgagaacttcatgcatctgatcattgctctgccggttgccatcctgctgatcgttggggggctggttatcatgctgtatgtcttccatagaaagagaaataacagcaggttgggcaatggagtgctgtatgcttctgtgaaccccgagtatttcagcgcagctgatgtgtacgtgcctgatgaatgggaggtagctcgagagaagatcaccatgaaccgggagctcggacaagggtcctttgggatggtctatgaaggagtggccaagggtgtggtcaaggatgaacccgaaaccagagtggccatcaagacggtaaacgaggctgcaagtatgcgtgaaagaatcgagtttctcaacgaggcctcggtgatgaaggagttcaattgtcaccatgtggtccggttgctgggtgtggtatcccaaggccagcccaccctggtcatcatggaactaatgacacgcggtgatctcaaaagttatctccggtctctgaggccagaagtggagcagaataatctagtcctcattcctccgagcttaagcaagatgatccagatggctggagagattgcagatggcatggcctacctcaatgccaacaagttcgtccacagagaccttgctgctaggaactgcatggtagccgaagatttcacagtcaaaattggagatttcggtatgacacgagacatctacgagacggactactaccggaaaggcgggaaggggttgctgcctgtgcgctggatgtctcccgagtccctcaaggatggtgtcttcactactcattctgatgtctggtccttcggggtcgtcctctgggagatcgccacgctggctgagcagccctaccagggcttgtccaacgagcaagttcttcgtttcgtcatggagggtggccttctggacaagccggacaactgccctgatatgctgtttgaacttatgcgcatgtgctggcagtataaccccaagatgcggccctccttcctggagatcatcggcagcatcaaggatgagatggagcccagcttccaggaggtctccttctactacagcgaggagaacaagcctcccgagccagaggagctggagatggagcctgagaacatggagagcgtcccactggacccttcggcctcctcagcctccctgcctctgcctgaaagacactcaggacacaaggctgagaatggcccgggccctggcgtgctcgttctccgcgccagttttgatgagagacagccttacgctcacatgaacgggggacgcgccaacgagagggccttgcctctgccccagtcctcgacctgctga

SEQ ID NO: 433 - protein, 1366 aa, Artificial Sequence
  mutated murine IGF-R1 antigen
MGWSCIILFLVATATGVHSDYKDDDDKEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCGDEEKKTKTIDSVTSAQMLQGCTILKGNLLINIRRGNNIASELENFMGLIEVVTGYVKIRHSHALVSLSFLKNLRLILGEEQLEGNYSFYVLDNQNLQQLWDWNHRNLTVRSGKMYFAFNPKLCVSEIYRMEEVTGTKGRQSKGDINTRNNGERASCESDVLRFTSTTTWKNRIIITWHRYRPPDYRDLISFTVYYKEAPFKNVTEYDGQDACGSNSWNMVDVDLPPNKEGEPGILLHGLKPWTQYAVYVKAVTLTMVENDHIRGAKSEILYIRTNASVPSIPLDVLSASNSSSQLIVKWNPPTLPNGNLSYYIVRWQRQPQDGYLYRHNYCSKDKIPIRKYADGTIDVEEVTENPKTEVCGGDKGPCCACPKTEAEKQAEKEEAEYRKVFENFLHNSIFVPRPERRRRDVMQVANTTMSSRSRNTTVADTYNITDPEEFETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVPAKTTYENFMHLIIALPVAILLIVGGLVIMLYVFHRKRNNSRLGNGVLYASVNPEYFSAADVYVPDEWEVAREKITMNRELGQGSFGMVYEGVAKGVVKDEPETRVAIKTVNEAASMRERIEFLNEASVMKEFNCHHVVRLLGVVSQGQPTLVIMELMTRGDLKSYLRSLRPEVEQNNLVLIPPSLSKMIQMAGEIADGMAYLNANKFVHRDLAARNCMVAEDFTVKIGDFGMTRDIYETDYYRKGGKGLLPVRWMSPESLKDGVFTTHSDVWSFGVVLWEIATLAEQPYQGLSNEQVLRFVMEGGLLDKPDNCPDMLFELMRMCWQYNPKMRPSFLEIIGSIKDEMEPSFQEVSFYYSEENKPPEPEELEMEPENMESVPLDPSASSASLPLPERHSGHKAENGPGPGVLVLRASFDERQPYAHMNGGRANERALPLPQSSTC

SEQ ID NO: 434 - DNA, 4104 bp, Artificial Sequence
  macaque IGF-R1
atgaagtctggctctggagaagggtccccgacctcgctgtgggggctcctgtttctctccgccgcgctctcgctctggccgacgagtggagaaatctgtgggccgggcatcgacatccgcaacgactatcagcagctgaagcgcctggagaactgcacggtgatcgagggctacctccacatcctgctcatctccaaggccgaggactaccgcagctaccgcttccccaagctcacggtcatcaccgagtacttgctgttgttccgagtggctggcctagagagcctcggagacctgttccccaacctcacggtaatccgcggctggaaactcttctacaactacgccctggtcatctttgagatgaccaatctcaaggatattgggctttacaacctgaggaacattactcggggggccatcaggattgagaaaaatgctgacctctgttacctctccactgtggactggtccctgatcctggatgcagtgtccaataactacattgtggggaataagcccccaaaggaatgcggggacctgtgtccggggaccatggaggagaagccgatgtgcgagaagaccaccatcaacaatgagtacaactaccgctgctggaccacaaaccgctgccagaaaatgtgcccgagtgcctgtgggaagagggcatgcaccgagaacaacgagtgctgccaccccgagtgcctgggcagctgcagcgcgcctgacaacgacacggcctgtgtagcttgccgccactactactacgccggtgtctgcgtgcctgcctgcccgcccaacacctacaggtttgagggctggcgctgtgtggaccgtgacttctgcgccaacatcctcagcgccgagagcagcgactccgagggtttcgtgatccacgacggcgagtgcatgcaggagtgcccctcaggcttcatccgcaacggcagccagagcatgtactgcatcccttgtgaaggtccttgccccaaggtctgtgaggaagaaaagaaaacaaagaccattgattctgttacttctgctcagatgctccaaggatgcaccatcttcaagggcaatttgctcattaacatccgacgggggaataacattgcttcagaactggagaacttcatggggctcatcgaggtggtgacgggctacgtgaagatccgccattcccatgccttggtctccttgtccttcctaaaaaaccttcgcctcatcttaggagaggagcagctagaagggaattactccttctacgtcctcgacaaccagaacttgcagcaactatgggactgggaccaccgcaacctgaccatcaaagcagggaaaatgtactttgctttcaatcccaaattgtgtgtttcggaaatttaccgcatggaggaagtgacggggactaaagggcgccaaagcaaaggggacataaacaccaggaacaacggggaaagagcctcctgtgaaagtgacgtcctgcatttcacctccaccaccacgtggaagaatcgcatcatcataacctggcaccggtaccggccccctgactacagggatctcatcagcttcaccgtttactacaaggaagcaccttttaagaatgtcacggagtatgatgggcaggatgcctgcggctccaacagctggaacatggtggatgtggacctcccgcccaacaaggacgtggagcccggcatcttactgcatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccattgacattgaggaggtcacagagaacccgaagactgaggtgtgtggtggagagaaagggccttgctgcgcctgccccaaaactgaagctgagaagcaggccgagaaggaggaggctgagtaccgcaaagtctttgagaatttcctgcacaactccatctttgtgcccagacctgaaaggaagcggagagatgtcatgcaagtggccaacaccaccatgtccagccgaagcaggaacaccacggtggcagacacctacaacatcacagatctggaagagctagagacagagtaccctttctttgagagcagagtggataataaggagagaactgtcatttctaaccttcggcctttcacattgtaccgcattgatatccacagctgcaaccacgaggctgagaaactgggctgcagcgcctccaactttgtctttgcaaggactatgcctgcagaaggagcagatgacattcctgggccagtgacctgggagccaaggcctgaaaactccatctttttaaagtggccagaacctgagaatcccaatggattgattctaatgtatgaaataaaatacggatcacaagttgaggatcagcgagaatgtgtgtccagacaggaatacaggaagtatggaggggccaagctaaaccggctaaacccagggaactacacagcccggattcaggctacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgatcatgctgtacgtcttccatagaaagagaaataacagcaggctggggaatggagtgctgtacgcgtctgtgaacccggagtacttcagcgctgcggatgtgtacgttcctgatgagtgggaggtggctcgggagaagatcaccatgagccgggaacttgggcaggggtcgtttgggatggtctatgaaggagttgccaagggtgtggtgaaagacgaacctgaaaccagagtggccattaaaacagtgaacgaggccgcgagcatgcgtgaaaggatcgagtttctcaacgaggcttctgtgatgaaggagttcaattgtcaccatgtggtgcggttgctgggtgtggtgtcccagggccagccaacgctggtcatcatggaactgatgacgcggggcgatctcaaaagttatctccggtctctgaggccagaaatggagaataatccagtcctagcacctccaagcctaagcaagatgattcagatggctggagagattgcagacggcatggcatacctcaacgccaacaagttcgtccacagagaccttgctgcccggaattgcatggtagccgaggatttcacagtcaaaattggagattttgggatgacgcgagatatctatgagacagactattaccggaaaggagggaaagggctgttgcccgtgcgctggatgtctcccgagtccctcaaggatggagtcttcaccacttactcggacgtctggtccttcggggttgtcctctgggagatcgccacactggccgagcagccctaccagggcttgtccaacgagcaagtccttcgcttcgtcatggagggcggccttctggacaagccagacaactgccccgacatgctgtttgaattgatgcgcatgtgctggcagtacaaccccaagatgaggccttccttcctggagatcatcagcagcatcaaagacgagatggagcctggcttccgggaggtctccttctactacagtgaggagaacaagctgcccgagccggaggagctggacctggagccagagaacatggagagcgtccccctggacccctcggcctcctcgtcctccctgccactgcccgacagacactcaggacacaaggccgagaacggccccggccctggagtgctggtgctccgcgccagcttcgatgagagacagccttacgcacacatgaacggtggccgcaagaacgagcgggccttgccgctgccccagtcttcgacctgctga

SEQ ID NO: 435 - protein, 1367 aa, Artificial Sequence
  macaque IGF-R1
MKSGSGEGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSACGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTWKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTVADTYNITDLEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKDEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 436 - protein, 362 aa, Homo sapiens
PAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVI

SEQ ID NO: 437 - protein, 42 aa, Homo sapiens
CRHFQSCSQCLSAPPFVQCGWCHDKCVRSEECLSGTWTQQIC

SEQ ID NO: 438 - protein, 212 aa, Homo sapiens
STKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLG

SEQ ID NO: 439 - protein, 907 aa, Homo sapiens
ECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNF

SEQ ID NO: 440 - protein, 326 aa, Homo sapiens
ASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDR

SEQ ID NO: 441 - protein, 116 aa, Homo sapiens
CSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISC

SEQ ID NO: 442 - protein, 55 aa, Homo sapiens
PAVYTTPFHLVSTEFEWLPFGSVAAVQCQAGRGASLLCVKQPEGGVGWSRAGPLC

SEQ ID NO: 443 - protein, 665 aa, Homo sapiens
WAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDR

SEQ ID NO: 444 - protein, 447 aa, Homo sapiens
SDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHL

SEQ ID NO: 445 - protein, 160 aa, Homo sapiens
KVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCE

SEQ ID NO: 446 - protein, 906 aa, Homo sapiens
EICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHL

SEQ ID NO: 447 - protein, 707 aa, Homo sapiens
KSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 448 - protein, 734 aa, Homo sapiens
RPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 449 - protein, 75 aa, Artificial Sequence
  primer 5'P6-VH-A-XhoI
CTTGATCTCGAGTCCGGCSCTGAGSTGRWGAAGCCTGGCGCCTCCGTGAAGRTGTCCTGCAAGGCCTCCGGCTAC

SEQ ID NO: 450 - protein, 78 aa, Artificial Sequence
  primer 3'P6-VH-B
CCATTCCAGCMSCTGGCCGGGTKYCTGTYTCACCCAGTGCATCACGTAGCCGGTGAAGGTGTAGCCGGAGGCCTTGCA

SEQ ID NO: 451 - protein, 75 aa, Artificial Sequence
  primer 5'P6-VH-C
CCCGGCCAGSKGCTGGAATGGATSGGCTACATCAACCCTTACAACGACGTGACCCGGTACAACGGCAAGTTCAAG

SEQ ID NO: 452 - protein, 69 aa, Artificial Sequence
  primer 3'P6-VH-D
TTCCATGTAGGCGGTGGAGGMGKACKTGTCKCTGGTAAKGGTGRCTYTGCCCTTGAACTTGCCGTTGTA

SEQ ID NO: 453 - protein, 69 aa, Artificial Sequence
  primer 5'P6-VH-E
TCCACCGCCTACATGGAACTGTCCRGCCTGASGTCTGAGGACACCGCCGTGTACTACTGCGCCAGGGGC

SEQ ID NO: 454 - protein, 72 aa, Artificial Sequence
  primer 3'P6-VH-F-BstEII
CGATACGGTGACCAGAGTGCCTCTGCCCCAGGAGTCGAAGTAGTACCAGTTCTCGCCCCTGGCGCAGTAGTA

SEQ ID NO: 455 - protein, 78 aa, Artificial Sequence
  primer 5'P6-VL-A-SacI
CTTGATGAGCTCGTGATGACCCAGTCTCCASYCTCCCTGSCTGTGACTCTGGGCCAGCSGGCCTCCATCTCTTGCCGG

SEQ ID NO: 456 - protein, 63 aa, Artificial Sequence
  primer 3'P6-VL-B
CCAGTGCATGAAGGTGTTGTCGTAGGAGTCGATGGACTCGGAGGCCCGGCAAGAGATGGAGGC

SEQ ID NO: 457 - protein, 75 aa, Artificial Sequence
  primer 5'P6-VL-C
ACCTTCATGCACTGGTWTCAGCAGARGCCTGGCCAGYCTCCTMRCCKGCTGATCTWCCGGGCCTCTATCCTGGAA

SEQ ID NO: 458 - protein, 72 aa, Artificial Sequence
  primer 3'P6-VL-D
CAGGGTGAAGTCGGTGCCGGAGCCAGAGCCGGAGAACCGGKCAGGGAYGCCGGATTCCAGGATAGAGGCCCG

SEQ ID NO: 459 - protein, 66 aa, Artificial Sequence
  primer 5'P6-VL-E
ACCGACTTCACCCTGAMAATCTMCCSTGTGGAGGCCGASGACGTGGSCRYCTACTACTGCCACCAG

SEQ ID NO: 460 - protein, 84 aa, Artificial Sequence
  primer 3'P6-VL-F-BsiWI/SpeI
ACTCAGACTAGTCGTACGCTTGATTTCCAGCTTGGTCCCTCCGCCGAAGGTGTAAGGGTCCTCGATGGACTGGTGGCAGTAGTA

SEQ ID NO: 461 - DNA, 2283 bp, Artificial Sequence
  huPSMArat140-169
atgtggaatctgcttcacgaaacagactcggctgtcgccaccgcgcggcgcccgcggtggctgtgcgccggggcgctggtcctggcgggtggattctttctcctgggcttcctctttgggtggtttatcaaatcctccaacgaagctactaatattactccaaaacataatatgaaggcatttttggacgaattgaaagccgagaacatcaaaaagttcttatacaattttacccagataccacacttagcaggaaccgaacaaaacttccagcttgcaaaacaaattcaatctcagtggaaagagtttggcctggactctgttgagctggcacattatgacgtcctgttgtcttacccaaataaaactcatcccaattacatctcaatcattaatgaagacggaaatgagatcttcaaaacatcattagctgaactgtcacccccgggatatgagaacatatcagatgtagtgccaccatacagtgccttctctccacaagggacacccgagggggacctagtgtatgtgaactatgcacggactgaagacttttttaaattggagcgggacatgaagatcaattgctccgggaaaattgtgattgccagatacgggaaagtttttagaggaaataaagttaaaaatgctcagctggcaggcgccaaaggagtgattctctactctgaccctgctgattactttgctcccggggtgaagtcatatccagatggctggaatcttcccggaggtggtgtgcagcgtggaaacatcctaaatctcaatggtgcaggcgaccctctcaccccaggttaccccgcaaatgaatacgcttataggcggggaattgcagaagctgttggtctgccaagtattccagttcatccaatcggatactatgacgcacagaagctgctagaaaagatgggtggctccgcaccaccagacagcagctggaggggaagtctcaaggtgccctacaacgttggacctggatttactggaaatttttctacacagaaagtcaaaatgcacatccattctaccaatgaggtgacaagaatctacaatgtgatcggtactctcaggggagcagtggagccagacaggtatgtcattctcggaggtcaccgcgactcatgggtctttggtggtatcgaccctcagagcggagcagctgtggttcatgaaatcgtgaggagcttcggaacactgaagaaggaaggctggagacctaggagaacaatcttgtttgcaagttgggatgcagaggaatttggtctgcttggttctaccgagtgggcagaagagaactcaagactcctgcaagagcgtggagtggcttatatcaatgctgactcctctatagaaggcaactacaccctgagagttgactgtacacccctgatgtacagtttggtacacaatctaacaaaagaactgaaaagccccgatgaaggcttcgaaggcaaatccctttatgaaagctggactaaaaagagtccttcccctgagttcagtggaatgcccaggatcagcaaattgggctctggaaatgactttgaggtgtttttccaacgactgggaattgcttccggcagagcacgctatactaaaaactgggaaacaaataaattcagtggctatcccctgtatcacagcgtctatgaaacctatgagttggtcgaaaagttttacgatccaatgttcaaatatcacctgactgtggctcaggttcgaggcgggatggtgttcgagctagccaactccatagtgctgccttttgattgccgagattatgccgtagttttaaggaagtatgctgataaaatctacagcatttctatgaagcatccacaggagatgaagacatatagtgtatcattcgattcacttttctctgcagtgaagaattttaccgaaattgcttctaagtttagtgagaggctccaggacttcgacaaaagcaatccaatagtattgagaatgatgaacgatcaactgatgtttctggagagagcatttatcgatccattaggcttaccagaccgccctttttatagacatgtcatctacgctccaagcagtcacaacaagtacgcaggggagtccttcccaggaatctatgatgccctgtttgacattgaaagcaaggtggacccttctaaggcctggggcgaagtgaagaggcagatttatgtggcagccttcaccgtgcaggcagccgcagagaccttgagtgaggtagcctccggggattacaaggacgacgatgacaagtaa

SEQ ID NO: 462 - protein, 760 aa, Artificial Sequence
  huPSMArat140-169
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFKTSLAELSPPGYENISDVVPPYSAFSPQGTPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVASGDYKDDDDK

SEQ ID NO: 463 - DNA, 2283 bp, Artificial Sequence
  huPSMArat281-284
atgtggaatctgcttcacgaaacagactcggctgtcgccaccgcgcggcgcccgcggtggctgtgcgccggggcgctggtcctggcgggtggattctttctcctgggcttcctctttgggtggtttatcaaatcctccaacgaagctactaatattactccaaaacataatatgaaggcatttttggacgaattgaaagccgagaacatcaaaaagttcttatacaattttacccagataccacacttagcaggaaccgaacaaaacttccagcttgcaaaacaaattcaatctcagtggaaagagtttggcctggactctgttgagctggcacattatgacgtcctgttgtcttacccaaataaaactcatcccaattacatctcaatcattaatgaagacggaaatgagatcttcaacacatccttatttgaaccccctcctccaggctatgaaaatgtgtcggatattgtgccacctttcagcgctttctctccccaaggaatgcccgagggcgacctagtgtatgtgaactatgcacggactgaagacttttttaaattggagcgggacatgaagatcaattgctccgggaaaattgtgattgccagatacgggaaagtttttagaggaaataaagttaaaaatgctcagctggcaggcgccaaaggagtgattctctactctgaccctgctgattactttgctcccggggtgaagtcatatccagatggctggaatcttcccggaggtggtgtgcagcgtggaaacatcctaaatctcaatggtgcaggcgacccgttaaccccaggttaccccgcaaatgaatacgcttataggcatgagttcacagaagctgttggtctgccaagtattccagttcatccaatcggatactatgacgcacagaagctgctagaaaagatgggtggctccgcaccaccagacagcagctggaggggaagcttgaaggtgccctacaacgttggacctggatttactggaaatttttctacacagaaagtcaaaatgcacatccattctaccaatgaggtgacaagaatctacaatgtgatcggtactctcaggggagcagtggagccagaccggtatgtcattctcggaggtcaccgcgactcatgggtctttggtggtatcgaccctcagagcggagcagctgtggttcatgaaatcgtgaggagcttcggaacactgaagaaggaaggctggagacctaggagaacaatcttgtttgcaagttgggatgcagaggaatttggtctgcttggttctaccgagtgggcagaagagaactcaagactcctgcaagagcgtggagtggcttatatcaatgctgactcctctatagaaggcaactacaccctgagagttgactgtacacccctgatgtacagtttggtacacaatctaacaaaagaactgaaaagccccgatgaaggcttcgaaggcaaatccctttatgaaagctggactaaaaagagtccttcccctgagttcagtggaatgcccaggatcagcaaattgggctctggaaatgactttgaggtgtttttccaacgactgggaattgcttccggcagagcacgctatactaaaaactgggaaacaaataaattcagtggctatcccctgtatcacagcgtctatgaaacctatgagttggtcgaaaagttttacgatccaatgttcaaatatcacctgactgtggctcaggttcgaggcgggatggtgttcgagctagccaactccatagtgctgccttttgattgccgagattatgccgtagttttaaggaagtatgctgataaaatctacagcatttctatgaagcatccacaggagatgaagacatatagtgtatcattcgattcacttttctctgcagtgaagaattttaccgaaattgcttctaagtttagtgagaggctccaggacttcgacaaaagcaatccaatagtattgagaatgatgaacgatcaactgatgtttctggagagagcatttatcgatccattaggcttaccagaccgccctttttatagacatgtcatctacgctccaagcagtcacaacaagtacgcaggggagtccttcccaggaatctatgatgccctgtttgacattgaaagcaaggtggacccttctaaggcctggggcgaagtgaagaggcagatttatgtggcagccttcaccgtgcaggcagccgcagagaccttgagtgaggtagcctccggggattacaaggacgacgatgacaagtaa

SEQ ID NO: 464 - protein, 760 aa, Artificial Sequence
  huPSMArat281-284
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRHEFTEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVASGDYKDDDDK

SEQ ID NO: 465 - DNA, 2283 bp, Artificial Sequence
  huPSMArat300-344
atgtggaatctgcttcacgaaacagactcggctgtcgccaccgcgcggcgcccgcggtggctgtgcgccggggcgctggtcctggcgggtggattctttctcctgggcttcctctttgggtggtttatcaaatcctccaacgaagctactaatattactccaaaacataatatgaaggcatttttggacgaattgaaagccgagaacatcaaaaagttcttatacaattttacccagataccacacttagcaggaaccgaacaaaacttccagcttgcaaaacaaattcaatctcagtggaaagagtttggcctggactctgttgagctggcacattatgacgtcctgttgtcttacccaaataaaactcatcccaattacatctcaatcattaatgaagacggaaatgagatcttcaacacatccttatttgaaccccctcctccaggctatgaaaatgtgtcggatattgtgccacctttcagcgctttctctccccaaggaatgcccgagggcgacctagtgtatgtgaactatgcacggactgaagacttttttaaattggagcgggacatgaagatcaattgctccgggaaaattgtgattgccagatacgggaaagtttttagaggaaataaagttaaaaatgctcagctggcaggcgccaaaggagtgattctctactctgaccctgctgattactttgctcccggggtgaagtcatatccagatggctggaatcttcccggaggtggtgtgcagcgtggaaacatcctaaatctcaatggtgcaggcgacccgttaaccccaggttaccccgcaaatgaatacgcttataggcggggaattgcagaagctgttggtctgccaagtattccagttcatccaatcggatacgatgatgcccagaaactattagaacatatgggtggctccgcaccccctgacagcagctggaagggaggactaaaagtgccttacaacgtgggacctggcttcgctggaaacttctcaaaacaaaaggtcaagctgcacatccattctaccaatgaggtgacaagaatctacaatgtgatcggtactctcaggggagcagtggagccagaccggtatgtcattctcggaggtcaccgcgactcatgggtctttggtggtatcgaccctcagagcggagcagctgtggttcatgaaatcgtgaggagcttcggaacactgaagaaggaaggctggagacctaggagaacaatcttgtttgcaagttgggatgcagaggaatttggtctgcttggttctaccgagtgggcagaagagaactcaagactcctgcaagagcgtggagtggcttatatcaatgctgactcctctatagaaggcaactacaccctgagagttgactgtacacccctgatgtacagtttggtacacaatctaacaaaagaactgaaaagccccgatgaaggcttcgaaggcaaatccctttatgaaagctggactaaaaagagtccttcccctgagttcagtggaatgcccaggatcagcaaattgggctctggaaatgactttgaggtgtttttccaacgactgggaattgcttccggcagagcacgctatactaaaaactgggaaacaaataaattcagtggctatcccctgtatcacagcgtctatgaaacctatgagttggtcgaaaagttttacgatccaatgttcaaatatcacctgactgtggctcaggttcgaggcgggatggtgttcgagctagccaactccatagtgctgccttttgattgccgagattatgccgtagttttaaggaagtatgctgataaaatctacagcatttctatgaagcatccacaggagatgaagacatatagtgtatcattcgattcacttttctctgcagtgaagaattttaccgaaattgcttctaagtttagtgagaggctccaggacttcgacaaaagcaatccaatagtattgagaatgatgaacgatcaactgatgtttctggagagagcatttatcgatccattaggcttaccagaccgccctttttatagacatgtcatctacgctccaagcagtcacaacaagtacgcaggggagtccttcccaggaatctatgatgccctgtttgacattgaaagcaaggtggacccttctaaggcctggggcgaagtgaagaggcagatttatgtggcagccttcaccgtgcaggcagccgcagagaccttgagtgaggtagcctccggggattacaaggacgacgatgacaagtaa

SEQ ID NO: 466 - protein, 760 aa, Artificial Sequence
  huPSMArat300-344
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYDDAQKLLEHMGGSAPPDSSWKGGLKVPYNVGPGFAGNFSKQKVKLHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVASGDYKDDDDK

SEQ ID NO: 467 - DNA, 2283 bp, Artificial Sequence
  huPSMArat598-617
atgtggaatctgcttcacgaaacagactcggctgtcgccaccgcgcggcgcccgcggtggctgtgcgccggggcgctggtcctggcgggtggattctttctcctgggcttcctctttgggtggtttatcaaatcctccaacgaagctactaatattactccaaaacataatatgaaggcatttttggacgaattgaaagccgagaacatcaaaaagttcttatacaattttacccagataccacacttagcaggaaccgaacaaaacttccagcttgcaaaacaaattcaatctcagtggaaagagtttggcctggactctgttgagctggcacattatgacgtcctgttgtcttacccaaataaaactcatcccaattacatctcaatcattaatgaagacggaaatgagatcttcaacacatccttatttgaaccccctcctccaggctatgaaaatgtgtcggatattgtgccacctttcagcgctttctctccccaaggaatgcccgagggcgacctagtgtatgtgaactatgcacggactgaagacttttttaaattggagcgggacatgaagatcaattgctccgggaaaattgtgattgccagatacgggaaagtttttagaggaaataaagttaaaaatgctcagctggcaggcgccaaaggagtgattctctactctgaccctgctgattactttgctcccggggtgaagtcatatccagatggctggaatcttcccggaggtggtgtgcagcgtggaaacatcctaaatctcaatggtgcaggcgaccctctcaccccaggttaccccgcaaatgaatacgcttataggcggggaattgcagaagctgttggtctgccaagtattccagttcatccaatcggatactatgacgcacagaagctgctagaaaagatgggtggctccgcaccaccagacagcagctggaggggaagtctcaaggtgccctacaacgttggacctggatttactggaaatttttctacacagaaagtcaaaatgcacatccattctaccaatgaggtgacaagaatctacaatgtgatcggtactctcaggggagcagtggagccagacaggtatgtcattctcggaggtcaccgcgactcatgggtctttggtggtatcgaccctcagagcggagcagctgtggttcatgaaatcgtgaggagcttcggaacactgaagaaggaaggctggagacctaggagaacaatcttgtttgcaagttgggatgcagaggaatttggtctgcttggttctaccgagtgggcagaagagaactcaagactcctgcaagagcgtggagtggcttatatcaatgctgactcctctatagaaggcaactacaccctgagagttgactgtacacccctgatgtacagtttggtacacaatctaacaaaagaactgaaaagccccgatgaaggcttcgaaggcaaatccctttatgaaagctggactaaaaagagtccttcccctgagttcagtggaatgcccaggatcagcaaattgggctctggaaatgactttgaggtgtttttccaacgactgggaattgcttccggcagagcacgctatactaaaaactgggaaacaaataaattcagtggctatcccctgtatcacagcgtctatgaaacctatgagttggtcgaaaagttttacgatccaatgttcaaatatcacctgactgtggctcaggttcgaggcgggatggtgttcgagctcgccaactccatagtgctgccttttgattgccaaagttatgctgtagctctgaagaaacatgctgagactatctacaacatttcaatgaatcatccacaggagatgaagacatatagtgtaagcttcgattcacttttctctgcagtgaagaattttaccgaaattgcttctaagtttagtgagaggctccaggacttcgacaaaagcaatccaatagtattgagaatgatgaacgatcaactgatgtttctggagagagcatttatcgatccattaggcttaccagaccgccctttttatagacatgtcatctacgctccaagcagtcacaacaagtacgcaggggagtccttcccaggaatctatgacgcgttgtttgacattgaaagcaaggtggacccttctaaggcctggggcgaagtgaagaggcagatttatgtggcagccttcaccgtgcaggcagccgcagagaccttgagtgaggtagcctccggggattacaaggacgacgatgacaagtaa

SEQ ID NO: 468 - protein, 760 aa, Artificial Sequence
  huPSMArat598-617
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCQSYAVALKKHAETIYNISMNHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVASGDYKDDDDK

SEQ ID NO: 469 - DNA, 2283 bp, Artificial Sequence
  huPSMArat683-690
atgtggaatctgcttcacgaaacagactcggctgtcgccaccgcgcggcgcccgcggtggctgtgcgccggggcgctggtcctggcgggtggattctttctcctgggcttcctctttgggtggtttatcaaatcctccaacgaagctactaatattactccaaaacataatatgaaggcatttttggacgaattgaaagccgagaacatcaaaaagttcttatacaattttacccagataccacacttagcaggaaccgaacaaaacttccagcttgcaaaacaaattcaatctcagtggaaagagtttggcctggactctgttgagctggcacattatgacgtcctgttgtcttacccaaataaaactcatcccaattacatctcaatcattaatgaagacggaaatgagatcttcaacacatccttatttgaaccccctcctccaggctatgaaaatgtgtcggatattgtgccacctttcagcgctttctctccccaaggaatgcccgagggcgacctagtgtatgtgaactatgcacggactgaagacttttttaaattggagcgggacatgaagatcaattgctccgggaaaattgtgattgccagatacgggaaagtttttagaggaaataaagttaaaaatgctcagctggcaggcgccaaaggagtgattctctactctgaccctgctgattactttgctcccggggtgaagtcatatccagatggctggaatcttcccggaggtggtgtgcagcgtggaaacatcctaaatctcaatggtgcaggcgaccctctcaccccaggttaccccgcaaatgaatacgcttataggcggggaattgcagaagctgttggtctgccaagtattccagttcatccaatcggatactatgacgcacagaagctgctagaaaagatgggtggctccgcaccaccagacagcagctggaggggaagtctcaaggtgccctacaacgttggacctggatttactggaaatttttctacacagaaagtcaaaatgcacatccattctaccaatgaggtgacaagaatctacaatgtgatcggtactctcaggggagcagtggagccagacaggtatgtcattctcggaggtcaccgcgactcatgggtctttggtggtatcgaccctcagagcggagcagctgtggttcatgaaatcgtgaggagcttcggaacactgaagaaggaaggctggagacctaggagaacaatcttgtttgcaagttgggatgcagaggaatttggtctgcttggttctaccgagtgggcagaagagaactcaagactcctgcaagagcgtggagtggcttatatcaatgctgactcctctatagaaggcaactacaccctgagagttgactgtacacccctgatgtacagtttggtacacaatctaacaaaagaactgaaaagccccgatgaaggcttcgaaggcaaatccctttatgaaagctggactaaaaagagtccttcccctgagttcagtggaatgcccaggatcagcaaattgggctctggaaatgactttgaggtgtttttccaacgactgggaattgcttccggcagagcacgctatactaaaaactgggaaacaaataaattcagtggctatcccctgtatcacagcgtctatgaaacctatgagttggtcgaaaagttttacgatccaatgttcaaatatcacctgactgtggctcaggttcgaggcgggatggtgttcgagctcgccaactccatagtgctgccttttgattgccgagattatgccgtagttttaaggaagtatgctgataaaatctacagcatttctatgaagcatccacaggagatgaagacatatagtgtatcattcgattcacttttctctgcagtgaagaattttaccgaaattgcttctaagtttagtgagaggctccaggacttcgacaaaagcaatccaatagtattgagaatgatgaacgatcaactgatgtttctggagcgcgcatttatcgatccattaggcttaccaggaaggcctttctacaggcatatcatctacgctccaagcagtcacaacaagtacgcaggggagtccttcccaggaatctatgacgcgttgtttgacattgaaagcaaggtggacccttctaaggcctggggcgaagtgaagaggcagatttatgtggcagccttcaccgtgcaggcagccgcagagaccttgagtgaggtagcctccggggattacaaggacgacgatgacaagtaa

SEQ ID NO: 470 - protein, 760 aa, Artificial Sequence
  huPSMArat683-690
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPGRPFYRHIIYAPSSHNKYAGESFPGIYDALFDIESKVDPSKAWGEVKRQIYVAAFTVQAAAETLSEVASGDYKDDDDK

SEQ ID NO: 471 - DNA, 2283 bp, Artificial Sequence
  huPSMArat716-750
atgtggaatctgcttcacgaaacagactcggctgtcgccaccgcgcggcgcccgcggtggctgtgcgccggggcgctggtcctggcgggtggattctttctcctgggcttcctctttgggtggtttatcaaatcctccaacgaagctactaatattactccaaaacataatatgaaggcatttttggacgaattgaaagccgagaacatcaaaaagttcttatacaattttacccagataccacacttagcaggaaccgaacaaaacttccagcttgcaaaacaaattcaatctcagtggaaagagtttggcctggactctgttgagctggcacattatgacgtcctgttgtcttacccaaataaaactcatcccaattacatctcaatcattaatgaagacggaaatgagatcttcaacacatccttatttgaaccccctcctccaggctatgaaaatgtgtcggatattgtgccacctttcagcgctttctctccccaaggaatgcccgagggcgacctagtgtatgtgaactatgcacggactgaagacttttttaaattggagcgggacatgaagatcaattgctccgggaaaattgtgattgccagatacgggaaagtttttagaggaaataaagttaaaaatgctcagctggcaggcgccaaaggagtgattctctactctgaccctgctgattactttgctcccggggtgaagtcatatccagatggctggaatcttcccggaggtggtgtgcagcgtggaaacatcctaaatctcaatggtgcaggcgaccctctcaccccaggttaccccgcaaatgaatacgcttataggcggggaattgcagaagctgttggtctgccaagtattccagttcatccaatcggatactatgacgcacagaagctgctagaaaagatgggtggctccgcaccaccagacagcagctggaggggaagtctcaaggtgccctacaacgttggacctggatttactggaaatttttctacacagaaagtcaaaatgcacatccattctaccaatgaggtgacaagaatctacaatgtgatcggtactctcaggggagcagtggagccagacaggtatgtcattctcggaggtcaccgcgactcatgggtctttggtggtatcgaccctcagagcggagcagctgtggttcatgaaatcgtgaggagcttcggaacactgaagaaggaaggctggagacctaggagaacaatcttgtttgcaagttgggatgcagaggaatttggtctgcttggttctaccgagtgggcagaagagaactcaagactcctgcaagagcgtggagtggcttatatcaatgctgactcctctatagaaggcaactacaccctgagagttgactgtacacccctgatgtacagtttggtacacaatctaacaaaagaactgaaaagccccgatgaaggcttcgaaggcaaatccctttatgaaagctggactaaaaagagtccttcccctgagttcagtggaatgcccaggatcagcaaattgggctctggaaatgactttgaggtgtttttccaacgactgggaattgcttccggcagagcacgctatactaaaaactgggaaacaaataaattcagtggctatcccctgtatcacagcgtctatgaaacctatgagttggtcgaaaagttttacgatccaatgttcaaatatcacctgactgtggctcaggttcgaggcgggatggtgttcgagctcgccaactccatagtgctgccttttgattgccgagattatgccgtagttttaaggaagtatgctgataaaatctacagcatttctatgaagcatccacaggagatgaagacatatagtgtatcattcgattcacttttctctgcagtgaagaattttaccgaaattgcttctaagtttagtgagaggctccaggacttcgacaaaagcaatccaatagtattgagaatgatgaacgatcaactgatgtttctggagcgcgcatttatcgatccattaggcttaccagaccgccctttttatagacatgtcatctacgctccaagcagtcacaacaagtacgcaggggagtccttcccaggaatctatgacgcgttgtttgacattaataacaaagtcgatacttctaaggcctggagagaagtgaaaagacagatttctattgcagcctttacagtgcaagctgcagcagagactctgagagaagtagactccggggattacaaggacgacgatgacaagtaa

SEQ ID NO: 472 - protein, 760 aa, Artificial Sequence
  huPSMArat716-750
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDINNKVDTSKAWREVKRQISIAAFTVQAAAETLREVDSGDYKDDDDK

SEQ ID NO: 473 - protein, 498 aa, Artificial Sequence
  PSMA-D4 HL x I2C HL
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 474 - DNA, 1494 bp, Artificial Sequence
  PSMA-D4 HL x I2C HL
caggtgcagctggtcgagtctggcggcggactggtgaagcctggcgagtccctgaggctgtcctgtgccgcctccggcttcaccttctccgactactacatgtactgggtccgccaggcccctgggaaggggctggaatgggtggccatcatctccgacggcggctactacacctactactccgacatcatcaagggccggttcaccatctcccgggacaacgccaagaacagcctgtacctgcagatgaactccctgaaggccgaggacaccgccgtgtactactgcgcccggggcttccctctgctgagacacggcgccatggattactggggccagggcaccctggtcaccgtctcctcaggtggtggtggttctggcggcggcggctccggtggtggtggttctgacatccagatgacccagtcccccagctccctgtccgcctccgtgggcgacagagtgaccatcacctgcaaggcctcccagaacgtggacaccaacgtggcctggtatcagcagaagcccggccaggcccctaagtccctgatctactccgcctcctaccggtactctgacgtgccttcccggttctccggctccgcgtccggcaccgacttcaccctgaccatctccagcgtgcagtctgaggacttcgccacgtactactgccagcagtacgactcctacccttacaccttcggcggagggaccaagctggaaatcaagtccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 475 - protein, 119 aa, Artificial Sequence
  PSMA-P7-H
EVQLLEQSGAELVKPGASVKLSCTASGFNIKDTYMDWVKQRPEQGLEWIARIDPANGDSKYDPKFQGKATITADTSSNTAYLQLSSLTSEDTAVYYCARGGMIWYFDVWGQGTTVTVSS

SEQ ID NO: 476 - protein, 5 aa, Artificial Sequence
  PSMA-P7-HCDR1
DTYMD

SEQ ID NO: 477 - protein, 17 aa, Artificial Sequence
  PSMA-P7-HCDR2
RIDPANGDSKYDPKFQG

SEQ ID NO: 478 - protein, 9 aa, Artificial Sequence
  PSMA-P7-HCDR3
GGMIWYFDV

SEQ ID NO: 479 - DNA, 357 bp, Artificial Sequence
  PSMA-P7-H
gaggtgcagctgctcgagcagtctggggcagagcttgtgaagccaggggcctcagtcaagttgtcctgcacagcttctggcttcaacattaaagacacctatatggactgggtgaagcagaggcctgaacagggcctggaatggattgcaaggattgatcctgcgaatggtgatagtaaatatgacccgaaattccagggcaaggccactataacagcagacacatcctccaacacagcctacctgcagctcagcagcctgacatctgaggacactgccgtctattattgtgctagaggcgggatgatatggtacttcgatgtctggggccaagggaccacggtcaccgtctcctca

SEQ ID NO: 480 - protein, 108 aa, Artificial Sequence
  PSMA-P7-L
ELVLTQSPTTMAASPGEKITITCSASSSISSNYLHWYQQKPGFSPKLLIYRTSNLASGVPARFSGSGSGTSYSLTIGTMEAEDVATYYCQQGSSLPYTFGGGTKLEIK

SEQ ID NO: 481 - protein, 12 aa, Artificial Sequence
  PSMA-P7-LCDR1
SASSSISSNYLH

SEQ ID NO: 482 - protein, 7 aa, Artificial Sequence
  PSMA-P7-LCDR2
RTSNLAS

SEQ ID NO: 483 - protein, 9 aa, Artificial Sequence
  PSMA-P7-LCDR3
QQGSSLPYT

SEQ ID NO: 484 - DNA, 324 bp, Artificial Sequence
  PSMA-P7-L
gagctcgtgctcacccagtctccaaccaccatggctgcatctcccggggagaagatcactatcacctgcagtgccagctcaagtataagttccaattacttgcattggtatcagcagaagccaggattctcccctaaactcttgatttataggacatccaatctggcttctggagtcccagctcgcttcagtggcagtgggtctgggacctcttactctctcacaattggcaccatggaggctgaagatgttgccacttactactgccagcagggtagtagtttaccgtacacgttcggaggggggaccaagcttgagatcaaa

SEQ ID NO: 485 - protein, 242 aa, Artificial Sequence
  PSMA-P7-HL
EVQLLEQSGAELVKPGASVKLSCTASGFNIKDTYMDWVKQRPEQGLEWIARIDPANGDSKYDPKFQGKATITADTSSNTAYLQLSSLTSEDTAVYYCARGGMIWYFDVWGQGTTVTVSSGGGGSGGGGSGGGGSELVLTQSPTTMAASPGEKITITCSASSSISSNYLHWYQQKPGFSPKLLIYRTSNLASGVPARFSGSGSGTSYSLTIGTMEAEDVATYYCQQGSSLPYTFGGGTKLEIK

SEQ ID NO: 486 - DNA, 726 bp, Artificial Sequence
  PSMA-P7-HL
gaggtgcagctgctcgagcagtctggggcagagcttgtgaagccaggggcctcagtcaagttgtcctgcacagcttctggcttcaacattaaagacacctatatggactgggtgaagcagaggcctgaacagggcctggaatggattgcaaggattgatcctgcgaatggtgatagtaaatatgacccgaaattccagggcaaggccactataacagcagacacatcctccaacacagcctacctgcagctcagcagcctgacatctgaggacactgccgtctattattgtgctagaggcgggatgatatggtacttcgatgtctggggccaagggaccacggtcaccgtctcctcaggtggtggtggttctggcggcggcggctccggtggtggtggttctgagctcgtgctcacccagtctccaaccaccatggctgcatctcccggggagaagatcactatcacctgcagtgccagctcaagtataagttccaattacttgcattggtatcagcagaagccaggattctcccctaaactcttgatttataggacatccaatctggcttctggagtcccagctcgcttcagtggcagtgggtctgggacctcttactctctcacaattggcaccatggaggctgaagatgttgccacttactactgccagcagggtagtagtttaccgtacacgttcggaggggggaccaagcttgagatcaaa

SEQ ID NO: 487 - protein, 497 aa, Artificial Sequence
  PSMA-P7 x I2C HL
EVQLLEQSGAELVKPGASVKLSCTASGFNIKDTYMDWVKQRPEQGLEWIARIDPANGDSKYDPKFQGKATITADTSSNTAYLQLSSLTSEDTAVYYCARGGMIWYFDVWGQGTTVTVSSGGGGSGGGGSGGGGSELVLTQSPTTMAASPGEKITITCSASSSISSNYLHWYQQKPGFSPKLLIYRTSNLASGVPARFSGSGSGTSYSLTIGTMEAEDVATYYCQQGSSLPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 488 - DNA, 1491 bp, Artificial Sequence
  PSMA-P7 x I2C HL
gaggtgcagctgctcgagcagtctggggcagagcttgtgaagccaggggcctcagtcaagttgtcctgcacagcttctggcttcaacattaaagacacctatatggactgggtgaagcagaggcctgaacagggcctggaatggattgcaaggattgatcctgcgaatggtgatagtaaatatgacccgaaattccagggcaaggccactataacagcagacacatcctccaacacagcctacctgcagctcagcagcctgacatctgaggacactgccgtctattattgtgctagaggcgggatgatatggtacttcgatgtctggggccaagggaccacggtcaccgtctcctcaggtggtggtggttctggcggcggcggctccggtggtggtggttctgagctcgtgctcacccagtctccaaccaccatggctgcatctcccggggagaagatcactatcacctgcagtgccagctcaagtataagttccaattacttgcattggtatcagcagaagccaggattctcccctaaactcttgatttataggacatccaatctggcttctggagtcccagctcgcttcagtggcagtgggtctgggacctcttactctctcacaattggcaccatggaggctgaagatgttgccacttactactgccagcagggtagtagtttaccgtacacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 489 - DNA, 2952 bp, Artificial Sequence
  cMET-1
atgggatggagctgtatcatcctcttcttggtagcaacagctacaggtgtacactccgagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtggacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaatagcagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaactcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacatccggaggtggtggatccggggctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgcataa

SEQ ID NO: 490 - protein, 983 aa, Artificial Sequence
  cMET-2
MGWSCIILFLVATATGVHSECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTSGGGGSGAGVIAVIVVVVIAIVAGIVVLVISRKKRMAKYEKAEIKEMGEMHRELNA

SEQ ID NO: 491 - DNA, 2952 bp, Artificial Sequence
  cMET-3
atgggatggagctgtatcatcctcttcttggtagcaacagctacaggtgtacactccgagtgtaaagaggcactagcaaagtccgagatgaatgtgaatatgaagtatcagcttcccaacttcaccgcggaaacagccatccagaatgtcattctacatgagcatcacattttcctcggtgccaccaactacatttatgttttaaatgaggaagaccttcagaaggttgctgagtacaagaccgggcctgtgctggaacacccagattgtttcccgtgtcaggactgcagcagcaaagccaatttatcaggaggcgtttggaaagataacatcaacatggctctggttgtggacacctactatgatgatcaactcattagctgtggcagcgtcaacagagggacctgccagcgacatgtctttccccataatcatactgctgacatacagtcggaggttcactgcatattctccccacagatagaagagcccaaccagtgccctgactgtgtggtgagcgccctgggagccaaagtcctttcatctgtaaaggaccggttcatcaacttctttgtaggcaataccataaattcttcttatttcccacatcatccgttgcattcgatatcagtgagaaggctaaaggaaacgaaagatggttttatgtttttgacagaccagtcctacattgatgttttacctgagttcagagattcttaccccattaagtacatccacgcttttgaaagcaacaattttatttacttcttgacggtccaaagggaaactctaaatgctcagacttttcacacaagaataatcaggttctgttccttaaactctggattgcactcctacatggaaatgcctctagagtgtattctcacagaaaagagaaaaaagagatccacaaagaaggaagtgtttaatatccttcaggctgcatatgtcagcaagcccggggcccagcttgctagacaaataggagccagcctgaatgatgacattctctttggggtgttcgcacaaagcaagccagattctgccgaaccaatggatcgatctgcaatgtgtgcatttcctatcaaatatgtcaacgacttcttcaacaagatcgtcaacaaaaacaatgtgagatgtctccagcatttttatggacccaatcatgagcactgttttaataggacacttctgagaaattcatcaggctgtgaagcgcgccgtgatgaatatcgagcagagtttaccacagctttgcagcgggttgacttattcatgggtcaattcagcgaagtcctcttaacatctatatccaccttcgtgaaaggagacctcaccatcgctaatcttgggacatcagagggtcgcttcatgcaggttgtggtttctcgatcaggaccatcaacccctcatgtgaattttctcctggactctcacccggtgtctccagaagtgattgtggagcatccattaaaccagaatggctacacactggttgtcacggggaagaagatcaccaagatcccattgaatggcttgggctgcagacatttccagtcctgcagtcagtgcctctctgccccaccctttgtgcagtgtggctggtgccacgacaaatgtgtgcgatcggaggaatgccccagtgggacatggactcaacagatctgtctgcctgcaatctacaaggttttcccaactagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataaacatttcaatatgtccataattatttcaaatggccacgggacaacacaatacagtacattttcctatgtggatcctataataacaagtatttcgccaaaatatggccctatggctggtggcactttacttactttaactggaaattacctaaacagtggcaattctagacacatttcaattggtggaaaaacatgtactttaaaaagtgtgtcaaacagtattctcgaatgttataccccagcccaaaccatttcaactgagtttgctgttaaattgaaaattgacttagccaaccgagagacaagcatcttcagttaccgggaagaccccattgtctatgaaattcatccaaccaaatcttttattagtggtgggagcacaataacaggtgttgggaaaaacctgcattcagttagtgtcccgaggatggtcataaatgtgcatgaagcaggaaggaactttacagtggcatgtcagcatcgctctaattcagagataatctgctgtaccactccttccctgcaacagctgaatctgcaactccccctgaaaaccaaagcctttttcatgttagatgggatcctttccaaatactttgatctcatttatgtacataatcctgtgtttaagccttttgaaaagccagtaatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacctccggaggtggtggatccggggctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgcataa

SEQ ID NO: 492 - protein, 983 aa, Artificial Sequence
  cMET-4
MGWSCIILFLVATATGVHSECKEALAKSEMNVNMKYQLPNFTAETAIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPNQCPDCVVSALGAKVLSSVKDRFINFFVGNTINSSYFPHHPLHSISVRRLKETKDGFMFLTDQSYIDVLPEFRDSYPIKYIHAFESNNFIYFLTVQRETLNAQTFHTRIIRFCSLNSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRAEFTTALQRVDLFMGQFSEVLLTSISTFVKGDLTIANLGTSEGRFMQVVVSRSGPSTPHVNFLLDSHPVSPEVIVEHPLNQNGYTLVVTGKKITKIPLNGLGCRHFQSCSQCLSAPPFVQCGWCHDKCVRSEECPSGTWTQQICLPAIYKVFPTSAPLEGGTRLTICGWDFGFRRNNKFDLKKTRVLLGNESCTLTLSESTMNTLKCTVGPAMNKHFNMSIIISNGHGTTQYSTFSYVDPIITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLHSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTSGGGGSGAGVIAVIVVVVIAIVAGIVVLVISRKKRMAKYEKAEIKEMGEMHRELNA

SEQ ID NO: 493 - DNA, 2973 bp, Artificial Sequence
  cMET-5
atgggatggagctgtatcatcctcttcttggtagcaacagctacaggtgtacactccgattacaaggacgacgatgacaaggagtgcaaggaggccctagtgaagtctgagatgaacgtgaacatgaagtatcagctccccaacttcacggcagaaacccccatccagaatgtcgtcctacacggccatcatatttatctcggagccacaaactacatttatgttttaaatgacaaagaccttcagaaggtatccgagttcaagaccgggcccgtgttggaacacccagattgtttaccttgtcgggactgcagcagcaaagccaattcatcaggaggggtttggaaagacaacatcaacatggctctgcttgttgacacatactatgatgatcaactcattagctgtggcagtgtcaacagagggacttgccagcggcatgtccttcctcctgacaattctgctgacatccagtctgaggtccactgcatgttctccccagaagaggagtcagggcagtgtcctgactgtgtagtgagtgccctcggagccaaagtcctcctgtcggaaaaggaccggttcatcaatttctttgtggggaatacgatcaattcctcctatcctcctggttattcactgcattcgatatcggtgagacggctgaaggaaacccaagatggttttaagtttttgacagaccagtcctatattgatgtcttaccagagttccaagattcctaccccataaagtacatacatgccttcgaaagcaaccattttatttactttctgactgtccaaaaggaaactctagatgctcagacttttcatacaagaataatcaggttctgttccgtagactctgggttgcactcctacatggaaatgcccctggaatgcatcctgacagaaaaaagaaggaagagatccacaagggaagaagtgtttaatatcctccaagccgcgtatgtcagtaaaccaggggccaatcttgctaagcaaataggagctagcccttctgatgacattctcttcggggtgtttgcacaaagcaagccagattctgctgaacctgtgaatcgatcagcagtctgtgcattccccatcaaatatgtcaatgacttcttcaacaagattgtcaacaaaaacaacgtgagatgtctccagcatttttacggacccaaccatgagcactgtttcaataggaccctgctgagaaactcttccggctgtgaagcgcgcagtgacgagtatcggacagagtttaccacggctttgcagcgcgtggacttattcatgggccggcttaaccaagtgctcctgacatccatctccaccttcatcaaaggtgacctcaccattgctaatctagggacgtcagaaggtcgcttcatgcaggtggtgctctctcgaacagcacacctcactcctcatgtgaacttcctcctggactcccatcctgtatctccagaagttattgttgagcatccatcaaatcaaaatggctatacattggttgtcacaggaaagaagatcaccaagattccattgaatggcctgggctgtggacatttccaatcctgcagtcagtgcctctctgccccttactttatacagtgtggctggtgccacaatcaatgtgtgcgttttgatgaatgccccagcggtacatggactcaagagatctgtctgccggcggtttataaggtgttccccaccagcgccccccttgaaggaggaacagtgttgaccatatgtggctgggactttggattcaggaagaataataaatttgatttaaggaaaaccaaagttctgcttggcaacgagagctgtaccttgaccttaagcgagagcacgacaaatacgttgaaatgcacagttggtcccgcgatgagtgagcacttcaatgtgtctgtaattatctcaaacagtcgagagacgacgcaatacagtgcattctcctatgtagatcctgtaataacaagcatttctccgaggtacggccctcaggctggaggcaccttactcactcttactgggaaatacctcaacagtggcaattctaggcacatttcaattggagggaaaacatgtactttaaaaagtgtatcagatagtattcttgaatgctacaccccagcccaaactacctctgatgagtttcctgtgaaattgaagattgacttggctaaccgagagaccagcagcttcagttaccgggaagaccccgttgtctatgaaatccacccgaccaaatcttttattagtggtggaagcacaataacgggtattgggaagaccctgaactcggttagcctcccaaagctggtaatagatgtgcatgaagtgggtgtgaactacacagtggcatgtcagcatcgctcaaattcagagatcatctgctgcactactccttcactgaaacagctgggcctgcaactccccctgaagaccaaagccttcttcctgttagacgggattctttccaaacactttgatctcacttatgtgcataatcctgtgtttgagccttttgaaaagccagtaatgatctcaataggcaatgaaaatgtagtggaaattaagggaaacaatattgaccctgaagcagttaaaggtgaagtgttaaaagttggaaatcagagctgcgagagtctccactggcactctggagctgtgttgtgtacagtccccagtgacctgctcaaactgaacagcgagctaaatatagagtggaagcaagcagtctcttcaactgttcttggaaaagtgatcgttcaaccggatcagaattttgcatccggaggtggtggatccggggctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgcataa

SEQ ID NO: 494 - protein, 990 aa, Artificial Sequence
  cMET-6
MGWSCIILFLVATATGVHSDYKDDDDKECKEALVKSEMNVNMKYQLPNFTAETPIQNVVLHGHHIYLGATNYIYVLNDKDLQKVSEFKTGPVLEHPDCLPCRDCSSKANSSGGVWKDNINMALLVDTYYDDQLISCGSVNRGTCQRHVLPPDNSADIQSEVHCMFSPEEESGQCPDCVVSALGAKVLLSEKDRFINFFVGNTINSSYPPGYSLHSISVRRLKETQDGFKFLTDQSYIDVLPEFQDSYPIKYIHAFESNHFIYFLTVQKETLDAQTFHTRIIRFCSVDSGLHSYMEMPLECILTEKRRKRSTREEVFNILQAAYVSKPGANLAKQIGASPSDDILFGVFAQSKPDSAEPVNRSAVCAFPIKYVNDFFNKIVNKNNVRCLQHFYGPNHEHCFNRTLLRNSSGCEARSDEYRTEFTTALQRVDLFMGRLNQVLLTSISTFIKGDLTIANLGTSEGRFMQVVLSRTAHLTPHVNFLLDSHPVSPEVIVEHPSNQNGYTLVVTGKKITKIPLNGLGCGHFQSCSQCLSAPYFIQCGWCHNQCVRFDECPSGTWTQEICLPAVYKVFPTSAPLEGGTVLTICGWDFGFRKNNKFDLRKTKVLLGNESCTLTLSESTTNTLKCTVGPAMSEHFNVSVIISNSRETTQYSAFSYVDPVITSISPRYGPQAGGTLLTLTGKYLNSGNSRHISIGGKTCTLKSVSDSILECYTPAQTTSDEFPVKLKIDLANRETSSFSYREDPVVYEIHPTKSFISGGSTITGIGKTLNSVSLPKLVIDVHEVGVNYTVACQHRSNSEIICCTTPSLKQLGLQLPLKTKAFFLLDGILSKHFDLTYVHNPVFEPFEKPVMISIGNENVVEIKGNNIDPEAVKGEVLKVGNQSCESLHWHSGAVLCTVPSDLLKLNSELNIEWKQAVSSTVLGKVIVQPDQNFASGGGGSGAGVIAVIVVVVIAIVAGIVVLVISRKKRMAKYEKAEIKEMGEMHRELNA

SEQ ID NO: 495 - DNA, 2976 bp, Artificial Sequence
  cMET-7
atgggatggagctgtatcatcctcttcttggtagcaacagctacaggtgtacactccgattacaaggacgacgatgacaaggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtggacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaagggaagaagtgtttaatatcctccaagccgcgtatgtcagtaaaccaggggccaatcttgctaagcaaataggagctagcccttctgatgacattctcttcggggtgtttgcacaaagcaagccagattctgctgaacctgtgaatcgatcagcagtctgtgcattccccatcaaatatgtcaatgacttcttcaacaagattgtcaacaaaaacaacgtgagatgtctccagcatttttacggacccaaccatgagcactgtttcaataggaccctgctgagaaactcttccggctgtgaagcgcgcagtgacgagtatcggacagagtttaccacggctttgcagcgcgtggacttattcatgggccggcttaaccaagtgctcctgacatccatctccaccttcatcaaaggtgacctcaccattgctaatctagggacgtcagaaggtcgcttcatgcaggtggtgctctctcgaacagcacacctcactcctcatgtgaacttcctcctggactcccatcctgtatctccagaagttattgttgagcatccatcaaatcaaaatggctatacattggttgtcacaggaaagaagatcaccaagattccattgaatggcctgggctgtggacatttccaatcctgcagtcagtgcctctctgccccttactttatacagtgtggctggtgccacaatcaatgtgtgcgttttgatgaatgccccagcggtacatggactcaagagatctgtctgccggcggtttataaggtgttccccaccagcgccccccttgaaggaggaacagtgttgaccatatgtggctgggactttggattcaggaagaataataaatttgatttaaggaaaaccaaagttctgcttggcaacgagagctgtaccttgaccttaagcgagagcacgacaaatacgttgaaatgcacagttggtcccgcgatgagtgagcacttcaatgtgtctgtaattatctcaaacagtcgagagacgacgcaatacagtgcattctcctatgtagatcctgtaataacaagcatttctccgaggtacggccctcaggctggaggcaccttactcactcttactgggaaatacctcaacagtggcaattctaggcacatttcaattggagggaaaacatgtactttaaaaagtgtatcagatagtattcttgaatgctacaccccagcccaaactacctctgatgagtttcctgtgaaattgaagattgacttggctaaccgagagaccagcagcttcagttaccgggaagaccccgttgtctatgaaatccacccgaccaaatcttttattagtggtggaagcacaataacgggtattgggaagaccctgaactcggttagcctcccaaagctggtaatagatgtgcatgaagtgggtgtgaactacacagtggcatgtcagcatcgctcaaattcagagatcatctgctgcactactccttcactgaaacagctgggcctgcaactccccctgaagaccaaagccttcttcctgttagacgggattctttccaaacactttgatctcacttatgtgcataatcctgtgtttgagccttttgaaaagccagtaatgatctcaataggcaatgaaaatgtagtggaaattaagggaaacaatattgaccctgaagcagttaaaggtgaagtgttaaaagttggaaatcagagctgcgagagtctccactggcactctggagctgtgttgtgtacagtccccagtgacctgctcaaactgaacagcgagctaaatatagagtggaagcaagcagtctcttcaactgttcttggaaaagtgatcgttcaaccggatcagaattttgcatccggaggtggtggatccggggctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgcataa

SEQ ID NO: 496 - protein, 991 aa, Artificial Sequence
  cMET-8
MGWSCIILFLVATATGVHSDYKDDDDKECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTREEVFNILQAAYVSKPGANLAKQIGASPSDDILFGVFAQSKPDSAEPVNRSAVCAFPIKYVNDFFNKIVNKNNVRCLQHFYGPNHEHCFNRTLLRNSSGCEARSDEYRTEFTTALQRVDLFMGRLNQVLLTSISTFIKGDLTIANLGTSEGRFMQVVLSRTAHLTPHVNFLLDSHPVSPEVIVEHPSNQNGYTLVVTGKKITKIPLNGLGCGHFQSCSQCLSAPYFIQCGWCHNQCVRFDECPSGTWTQEICLPAVYKVFPTSAPLEGGTVLTICGWDFGFRKNNKFDLRKTKVLLGNESCTLTLSESTTNTLKCTVGPAMSEHFNVSVIISNSRETTQYSAFSYVDPVITSISPRYGPQAGGTLLTLTGKYLNSGNSRHISIGGKTCTLKSVSDSILECYTPAQTTSDEFPVKLKIDLANRETSSFSYREDPVVYEIHPTKSFISGGSTITGIGKTLNSVSLPKLVIDVHEVGVNYTVACQHRSNSEIICCTTPSLKQLGLQLPLKTKAFFLLDGILSKHFDLTYVHNPVFEPFEKPVMISIGNENVVEIKGNNIDPEAVKGEVLKVGNQSCESLHWHSGAVLCTVPSDLLKLNSELNIEWKQAVSSTVLGKVIVQPDQNFASGGGGSGAGVIAVIVVVVIAIVAGIVVLVISRKKRMAKYEKAEIKEMGEMHRELNA

SEQ ID NO: 497 - DNA, 2973 bp, Artificial Sequence
  cMET-9
atgggatggagctgtatcatcctcttcttggtagcaacagctacaggtgtacactccgattacaaggacgacgatgacaaggagtgcaaggaggccctagtgaagtctgagatgaacgtgaacatgaagtatcagctccccaacttcacggcagaaacccccatccagaatgtcgtcctacacggccatcatatttatctcggagccacaaactacatttatgttttaaatgacaaagaccttcagaaggtatccgagttcaagaccgggcccgtgttggaacacccagattgtttaccttgtcgggactgcagcagcaaagccaattcatcaggaggggtttggaaagacaacatcaacatggctctgcttgttgacacatactatgatgatcaactcattagctgtggcagtgtcaacagagggacttgccagcggcatgtccttcctcctgacaattctgctgacatccagtctgaggtccactgcatgttctccccagaagaggagtcagggcagtgtcctgactgtgtagtgagtgccctcggagccaaagtcctcctgtcggaaaaggaccggttcatcaatttctttgtggggaatacgatcaattcctcctatcctcctggttattcactgcattcgatatcggtgagacggctgaaggaaacccaagatggttttaagtttttgacagaccagtcctatattgatgtcttaccagagttccaagattcctaccccataaagtacatacatgccttcgaaagcaaccattttatttactttctgactgtccaaaaggaaactctagatgctcagacttttcatacaagaataatcaggttctgttccgtagactctgggttgcactcctacatggaaatgcccctggaatgcatcctgacagaaaaaagaaggaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaatagcagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaactcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacatccggaggtggtggatccggggctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgcataa

SEQ ID NO: 498 - protein, 990 aa, Artificial Sequence
  cMET-10
MGWSCIILFLVATATGVHSDYKDDDDKECKEALVKSEMNVNMKYQLPNFTAETPIQNVVLHGHHIYLGATNYIYVLNDKDLQKVSEFKTGPVLEHPDCLPCRDCSSKANSSGGVWKDNINMALLVDTYYDDQLISCGSVNRGTCQRHVLPPDNSADIQSEVHCMFSPEEESGQCPDCVVSALGAKVLLSEKDRFINFFVGNTINSSYPPGYSLHSISVRRLKETQDGFKFLTDQSYIDVLPEFQDSYPIKYIHAFESNHFIYFLTVQKETLDAQTFHTRIIRFCSVDSGLHSYMEMPLECILTEKRRKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTSGGGGSGAGVIAVIVVVVIAIVAGIVVLVISRKKRMAKYEKAEIKEMGEMHRELNA

SEQ ID NO: 499 - protein, 119 aa, Artificial Sequence
  ME86H11-H
QVQLVQSGAEVKRPGASVKVSCRASGYTFTSYWLHWVRQGPGQRLEWIGMIDPSNSDTRFNPNFKDRATFTVDTSASTAYMELSSLTSEDTAVYYCATYGSYVSPLDYWGQGTSVTVSS

SEQ ID NO: 500 - protein, 5 aa, Artificial Sequence
  ME86H11-HCDR1
SYWLH

SEQ ID NO: 501 - protein, 17 aa, Artificial Sequence
  ME86H11-HCDR2
MIDPSNSDTRFNPNFKD

SEQ ID NO: 502 - protein, 10 aa, Artificial Sequence
  ME86H11-HCDR3
YGSYVSPLDY

SEQ ID NO: 503 - DNA, 357 bp, Artificial Sequence
  ME86H11-H
caggtgcagctggtccagtctggggctgaagtgaagaggcctggggcttcagtgaaagtgtcctgcagggcttcgggctataccttcaccagctactggttgcactgggttagacaggggcctggacaaaggcttgagtggataggcatgattgatccttccaatagtgacactaggtttaatccgaacttcaaggacagggccacattcactgtagacacatctgccagcacagcctacatggagctcagcagcctgacatctgaggacactgcagtctattactgtgccacatatggtagctacgtttcccctctggactactggggtcaaggaacctcggtcaccgtctcctca

SEQ ID NO: 504 - protein, 113 aa, Artificial Sequence
  ME86H11-L
DIVMTQTPFSLPVTLGETVSISCKSSQSLLYTSSQKNYLAWYLQKPGQSPQLLIYWASTRESGVPDRFSGSGSGTDFTLKISRVEAEDVGVYYCQQYYAYPWTFGGGTKLEIK

SEQ ID NO: 505 - protein, 17 aa, Artificial Sequence
  ME86H11-LCDR1
KSSQSLLYTSSQKNYLA

SEQ ID NO: 506 - protein, 7 aa, Artificial Sequence
  ME86H11-LCDR2
WASTRES

SEQ ID NO: 507 - protein, 9 aa, Artificial Sequence
  ME86H11-LCDR3
QQYYAYPWT

SEQ ID NO: 508 - DNA, 339 bp, Artificial Sequence
  ME86H11-L
gacatcgtgatgacccagactccattctccctacctgtgacacttggagagacggtttctatcagctgcaagtccagtcagtcccttttatatactagcagtcagaagaactacttggcctggtacctgcagaaaccaggtcagtctcctcaactgctgatttactgggcatccactagggaatctggggtccctgatcgcttctcaggcagtggatctgggacagatttcactctcaaaatctccagagtggaggctgaggacgtgggagtttattactgtcagcaatattatgcctatccgtggacgttcggtggaggcacaaagttggagatcaaa

SEQ ID NO: 509 - protein, 247 aa, Artificial Sequence
  ME86H11-HL
QVQLVQSGAEVKRPGASVKVSCRASGYTFTSYWLHWVRQGPGQRLEWIGMIDPSNSDTRFNPNFKDRATFTVDTSASTAYMELSSLTSEDTAVYYCATYGSYVSPLDYWGQGTSVTVSSGGGGSGGGGSGGGGSDIVMTQTPFSLPVTLGETVSISCKSSQSLLYTSSQKNYLAWYLQKPGQSPQLLIYWASTRESGVPDRFSGSGSGTDFTLKISRVEAEDVGVYYCQQYYAYPWTFGGGTKLEIK

SEQ ID NO: 510 - DNA, 741 bp, Artificial Sequence
  ME86H11-HL
caggtgcagctggtccagtctggggctgaagtgaagaggcctggggcttcagtgaaagtgtcctgcagggcttcgggctataccttcaccagctactggttgcactgggttagacaggggcctggacaaaggcttgagtggataggcatgattgatccttccaatagtgacactaggtttaatccgaacttcaaggacagggccacattcactgtagacacatctgccagcacagcctacatggagctcagcagcctgacatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccattctccctacctgtgacacttggagagacggtttctatcagctgcaagtccagtcagtcccttttatatactagcagtcagaagaactacttggcctggtacctgcagaaaccaggtcagtctcctcaactgctgatttactgggcatccactagggaatctggggtccctgatcgcttctcaggcagtggatctgggacagatttcactctcaaaatctccagagtggaggctgaggacgtgggagtttattactgtcagcaatattatgcctatccgtggacgttcggtggaggcacaaagttggagatcaaa

SEQ ID NO: 511 - protein, 502 aa, Artificial Sequence
  ME86H11 HL x I2C HL
QVQLVQSGAEVKRPGASVKVSCRASGYTFTSYWLHWVRQGPGQRLEWIGMIDPSNSDTRFNPNFKDRATFTVDTSASTAYMELSSLTSEDTAVYYCATYGSYVSPLDYWGQGTSVTVSSGGGGSGGGGSGGGGSDIVMTQTPFSLPVTLGETVSISCKSSQSLLYTSSQKNYLAWYLQKPGQSPQLLIYWASTRESGVPDRFSGSGSGTDFTLKISRVEAEDVGVYYCQQYYAYPWTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 512 - DNA, 1506 bp, Artificial Sequence
  ME86H11 HL x I2C HL
caggtgcagctggtccagtctggggctgaagtgaagaggcctggggcttcagtgaaagtgtcctgcagggcttcgggctataccttcaccagctactggttgcactgggttagacaggggcctggacaaaggcttgagtggataggcatgattgatccttccaatagtgacactaggtttaatccgaacttcaaggacagggccacattcactgtagacacatctgccagcacagcctacatggagctcagcagcctgacatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccattctccctacctgtgacacttggagagacggtttctatcagctgcaagtccagtcagtcccttttatatactagcagtcagaagaactacttggcctggtacctgcagaaaccaggtcagtctcctcaactgctgatttactgggcatccactagggaatctggggtccctgatcgcttctcaggcagtggatctgggacagatttcactctcaaaatctccagagtggaggctgaggacgtgggagtttattactgtcagcaatattatgcctatccgtggacgttcggtggaggcacaaagttggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 513 - protein, 119 aa, Artificial Sequence
  ME62A12-H
QVQLVQSGAEVVKPGASVKVSCKASGYTFTSYWLHWVRQTPGQGLEWIGMIDPSNSDTRFNPNFKDKVTFTVDTSASTAYMELSSLRSEDTAVYYCATYGSYVSPLDYWGQGTSVTVSS

SEQ ID NO: 514 - protein, 5 aa, Artificial Sequence
  ME62A12-HCDR1
SYWLH

SEQ ID NO: 515 - protein, 17 aa, Artificial Sequence
  ME62A12-HCDR2
MIDPSNSDTRFNPNFKD

SEQ ID NO: 516 - protein, 10 aa, Artificial Sequence
  ME62A12-HCDR3
YGSYVSPLDY

SEQ ID NO: 517 - DNA, 357 bp, Artificial Sequence
  ME62A12-H
caggtgcagctggtccagtctggggctgaagtggtgaagcctggggcttcagtgaaagtgtcctgcaaggcttcgggctataccttcaccagctactggttgcactgggttagacagacgcctggacaagggcttgagtggataggcatgattgatccttccaatagtgacactaggtttaatccgaacttcaaggacaaggtcacattcactgtagacacatctgccagcacagcctacatggaactcagcagcctgagatctgaggacactgcagtctattactgtgccacatatggtagctacgtttcccctctggactactggggtcaaggaacctcggtcaccgtctcctca

SEQ ID NO: 518 - protein, 113 aa, Artificial Sequence
  ME62A12-L
DIVMTQTPLSLPVTLGEKVSVSCKSSQSLLYTSSQKNYLAWYQQKPGQSPKLLIYWASTRESGVPDRFSGSGSGTDFTLTISRVEAEDLGVYYCQQYYAYPWTFGGGTKLEIK

SEQ ID NO: 519 - protein, 17 aa, Artificial Sequence
  ME62A12-LCDR1
KSSQSLLYTSSQKNYLA

SEQ ID NO: 520 - protein, 7 aa, Artificial Sequence
  ME62A12-LCDR2
WASTRES

SEQ ID NO: 521 - protein, 9 aa, Artificial Sequence
  ME62A12-LCDR3
QQYYAYPWT

SEQ ID NO: 522 - DNA, 339 bp, Artificial Sequence
  ME62A12-L
gacatcgtgatgacccagactccactctccctacctgtgacacttggagagaaggtttctgtcagctgcaagtccagtcagtcccttttatatactagcagtcagaagaactacttggcctggtaccagcagaaaccaggtcagtctcctaaactgctgatttactgggcatccactagggaatctggggtccctgatcgcttctcaggcagtggatctgggacagatttcactctcacaatctccagagtggaggctgaggacctgggagtttattactgtcagcaatattatgcctatccgtggacgttcggtggaggcacaaagttggagatcaaa

SEQ ID NO: 523 - protein, 247 aa, Artificial Sequence
  ME62A12-HL
QVQLVQSGAEVVKPGASVKVSCKASGYTFTSYWLHWVRQTPGQGLEWIGMIDPSNSDTRFNPNFKDKVTFTVDTSASTAYMELSSLRSEDTAVYYCATYGSYVSPLDYWGQGTSVTVSSGGGGSGGGGSGGGGSDIVMTQTPLSLPVTLGEKVSVSCKSSQSLLYTSSQKNYLAWYQQKPGQSPKLLIYWASTRESGVPDRFSGSGSGTDFTLTISRVEAEDLGVYYCQQYYAYPWTFGGGTKLEIK

SEQ ID NO: 524 - DNA, 741 bp, Artificial Sequence
  ME62A12-HL
caggtgcagctggtccagtctggggctgaagtggtgaagcctggggcttcagtgaaagtgtcctgcaaggcttcgggctataccttcaccagctactggttgcactgggttagacagacgcctggacaagggcttgagtggataggcatgattgatccttccaatagtgacactaggtttaatccgaacttcaaggacaaggtcacattcactgtagacacatctgccagcacagcctacatggaactcagcagcctgagatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccactctccctacctgtgacacttggagagaaggtttctgtcagctgcaagtccagtcagtcccttttatatactagcagtcagaagaactacttggcctggtaccagcagaaaccaggtcagtctcctaaactgctgatttactgggcatccactagggaatctggggtccctgatcgcttctcaggcagtggatctgggacagatttcactctcacaatctccagagtggaggctgaggacctgggagtttattactgtcagcaatattatgcctatccgtggacgttcggtggaggcacaaagttggagatcaaa

SEQ ID NO: 525 - protein, 502 aa, Artificial Sequence
  ME62A12 HL x I2C HL
QVQLVQSGAEVVKPGASVKVSCKASGYTFTSYWLHWVRQTPGQGLEWIGMIDPSNSDTRFNPNFKDKVTFTVDTSASTAYMELSSLRSEDTAVYYCATYGSYVSPLDYWGQGTSVTVSSGGGGSGGGGSGGGGSDIVMTQTPLSLPVTLGEKVSVSCKSSQSLLYTSSQKNYLAWYQQKPGQSPKLLIYWASTRESGVPDRFSGSGSGTDFTLTISRVEAEDLGVYYCQQYYAYPWTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 526 - DNA, 1506 bp, Artificial Sequence
  ME62A12 HL x I2C HL
caggtgcagctggtccagtctggggctgaagtggtgaagcctggggcttcagtgaaagtgtcctgcaaggcttcgggctataccttcaccagctactggttgcactgggttagacagacgcctggacaagggcttgagtggataggcatgattgatccttccaatagtgacactaggtttaatccgaacttcaaggacaaggtcacattcactgtagacacatctgccagcacagcctacatggaactcagcagcctgagatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccactctccctacctgtgacacttggagagaaggtttctgtcagctgcaagtccagtcagtcccttttatatactagcagtcagaagaactacttggcctggtaccagcagaaaccaggtcagtctcctaaactgctgatttactgggcatccactagggaatctggggtccctgatcgcttctcaggcagtggatctgggacagatttcactctcacaatctccagagtggaggctgaggacctgggagtttattactgtcagcaatattatgcctatccgtggacgttcggtggaggcacaaagttggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 527 - protein, 119 aa, Artificial Sequence
  ME63F2-H
QVQLVQSGAEVKRPGASVKVSCKASGYTFTSYWLHWVRQTPGQRLEWIGMIDPSNSDTRFNPNFKDRVTMTVDTSANTAYMELSSLRSEDTAVYYCATYGSYVSPLDYWGQGTSVTVSS

SEQ ID NO: 528 - protein, 5 aa, Artificial Sequence
  ME63F2-HCDR1
SYWLH

SEQ ID NO: 529 - protein, 17 aa, Artificial Sequence
  ME63F2-HCDR2
MIDPSNSDTRFNPNFKD

SEQ ID NO: 530 - protein, 10 aa, Artificial Sequence
  ME63F2-HCDR3
YGSYVSPLDY

SEQ ID NO: 531 - DNA, 357 bp, Artificial Sequence
  ME63F2-H
caggtgcagctggtccagtctggggctgaagtgaagaggcctggggcttcagtgaaagtgtcctgcaaggcttcgggctataccttcaccagctactggttgcactgggttagacagacgcctggacaaaggcttgagtggataggcatgattgatccttccaatagtgacactaggtttaatccgaacttcaaggacagggtcacaatgactgtagacacatctgccaacacagcctacatggaactcagcagcctgagatctgaggacactgcagtctattactgtgccacatatggtagctacgtttcccctctggactactggggtcaaggaacctcggtcaccgtctcctca

SEQ ID NO: 532 - protein, 113 aa, Artificial Sequence
  ME63F2-L
DIVMTQTPLSLPVTVGEQASISCKSSQSLLYTSSQKNYLAWYQQKPGQSPKLLIYWASTRESGVPDRFSGSGSGTDFTLKISRVEAEDLGVYYCQQYYAYPWTFGGGTKLEIK

SEQ ID NO: 533 - protein, 17 aa, Artificial Sequence
  ME63F2-LCDR1
KSSQSLLYTSSQKNYLA

SEQ ID NO: 534 - protein, 7 aa, Artificial Sequence
  ME63F2-LCDR2
WASTRES

SEQ ID NO: 535 - protein, 9 aa, Artificial Sequence
  ME63F2-LCDR3
QQYYAYPWT

SEQ ID NO: 536 - DNA, 339 bp, Artificial Sequence
  ME63F2-L
gacatcgtgatgacccagactccactctccctacctgtgacagttggagagcaggcttctatcagctgcaagtccagtcagtcccttttatatactagcagtcagaagaactacttggcctggtaccagcagaaaccaggtcagtctcctaaactgctgatttactgggcatccactagggaatctggggtccctgatcgcttctcaggcagtggatctgggacagatttcactctcaaaatctccagagtggaggctgaggacctgggagtttattactgtcagcaatattatgcctatccgtggacgttcggtggaggcacaaagttggagatcaaa

SEQ ID NO: 537 - protein, 247 aa, Artificial Sequence
  ME63F2-HL
QVQLVQSGAEVKRPGASVKVSCKASGYTFTSYWLHWVRQTPGQRLEWIGMIDPSNSDTRFNPNFKDRVTMTVDTSANTAYMELSSLRSEDTAVYYCATYGSYVSPLDYWGQGTSVTVSSGGGGSGGGGSGGGGSDIVMTQTPLSLPVTVGEQASISCKSSQSLLYTSSQKNYLAWYQQKPGQSPKLLIYWASTRESGVPDRFSGSGSGTDFTLKISRVEAEDLGVYYCQQYYAYPWTFGGGTKLEIK

SEQ ID NO: 538 - DNA, 741 bp, Artificial Sequence
  ME63F2-HL
caggtgcagctggtccagtctggggctgaagtgaagaggcctggggcttcagtgaaagtgtcctgcaaggcttcgggctataccttcaccagctactggttgcactgggttagacagacgcctggacaaaggcttgagtggataggcatgattgatccttccaatagtgacactaggtttaatccgaacttcaaggacagggtcacaatgactgtagacacatctgccaacacagcctacatggaactcagcagcctgagatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccactctccctacctgtgacagttggagagcaggcttctatcagctgcaagtccagtcagtcccttttatatactagcagtcagaagaactacttggcctggtaccagcagaaaccaggtcagtctcctaaactgctgatttactgggcatccactagggaatctggggtccctgatcgcttctcaggcagtggatctgggacagatttcactctcaaaatctccagagtggaggctgaggacctgggagtttattactgtcagcaatattatgcctatccgtggacgttcggtggaggcacaaagttggagatcaaa

SEQ ID NO: 539 - protein, 502 aa, Artificial Sequence
  ME63F2 HL x I2C HL
QVQLVQSGAEVKRPGASVKVSCKASGYTFTSYWLHWVRQTPGQRLEWIGMIDPSNSDTRFNPNFKDRVTMTVDTSANTAYMELSSLRSEDTAVYYCATYGSYVSPLDYWGQGTSVTVSSGGGGSGGGGSGGGGSDIVMTQTPLSLPVTVGEQASISCKSSQSLLYTSSQKNYLAWYQQKPGQSPKLLIYWASTRESGVPDRFSGSGSGTDFTLKISRVEAEDLGVYYCQQYYAYPWTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 540 - DNA, 1506 bp, Artificial Sequence
  ME63F2 HL x I2C HL
caggtgcagctggtccagtctggggctgaagtgaagaggcctggggcttcagtgaaagtgtcctgcaaggcttcgggctataccttcaccagctactggttgcactgggttagacagacgcctggacaaaggcttgagtggataggcatgattgatccttccaatagtgacactaggtttaatccgaacttcaaggacagggtcacaatgactgtagacacatctgccaacacagcctacatggaactcagcagcctgagatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccactctccctacctgtgacagttggagagcaggcttctatcagctgcaagtccagtcagtcccttttatatactagcagtcagaagaactacttggcctggtaccagcagaaaccaggtcagtctcctaaactgctgatttactgggcatccactagggaatctggggtccctgatcgcttctcaggcagtggatctgggacagatttcactctcaaaatctccagagtggaggctgaggacctgggagtttattactgtcagcaatattatgcctatccgtggacgttcggtggaggcacaaagttggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 541 - protein, 119 aa, Artificial Sequence
  ME62D11-H
QVQLVQSGPEVVKPGASVKVSCKASGYTFTSYWLHWVKQAPGQGLEWIGMIDPSNSDTRFNPNFKDRATLTVDTSASTAYMLLSSLRSEDTAVYYCATYGSYVSPLDYWGQGTSVTVSS

SEQ ID NO: 542 - protein, 5 aa, Artificial Sequence
  ME62D11-HCDR1
SYWLH

SEQ ID NO: 543 - protein, 17 aa, Artificial Sequence
  ME62D11-HCDR2
MIDPSNSDTRFNPNFKD

SEQ ID NO: 544 - protein, 10 aa, Artificial Sequence
  ME62D11-HCDR3
YGSYVSPLDY

SEQ ID NO: 545 - DNA, 357 bp, Artificial Sequence
  ME62D11-H
caggtgcagctggtccagtctgggcctgaagtggtgaagcctggggcttcagtgaaagtgtcctgcaaggcttcgggctataccttcaccagctactggttgcactgggttaaacaggcgcctggacaagggcttgagtggataggcatgattgatccttccaatagtgacactaggtttaatccgaacttcaaggacagggccacattgactgtagacacatctgccagcacagcctacatgctactcagcagcctgagatctgaggacactgcagtctattactgtgccacatatggtagctacgtttcccctctggactactggggtcaaggaacctcggtcaccgtctcctca

SEQ ID NO: 546 - protein, 113 aa, Artificial Sequence
  ME62D11-L
DIVMTQTPSSLPVTLGETVSISCKSSQSLLYTSSQKNYLAWYLQKPGQSPQLLIYWASTRESGVPDRFSGSGSGTDFTLTISRVKAEDVAVYYCQQYYAYPWTFGGGTKLEIK

SEQ ID NO: 547 - protein, 17 aa, Artificial Sequence
  ME62D11-LCDR1
KSSQSLLYTSSQKNYLA

SEQ ID NO: 548 - protein, 7 aa, Artificial Sequence
  ME62D11-LCDR2
WASTRES

SEQ ID NO: 549 - protein, 9 aa, Artificial Sequence
  ME62D11-LCDR3
QQYYAYPWT

SEQ ID NO: 550 - DNA, 339 bp, Artificial Sequence
  ME62D11-L
gacatcgtgatgacccagactccatcctccctacctgtgacacttggagagacggtttctatcagctgcaagtccagtcagtcccttttatatactagcagtcagaagaactacttggcctggtacctgcagaaaccaggtcagtctcctcaactgctgatttactgggcatccactagggaatctggggtccctgatcgcttctcaggcagtggatctgggacagatttcactctcacaatctccagagtgaaggctgaggacgtggcagtttattactgtcagcaatattatgcctatccgtggacgttcggtggaggcacaaagttggagatcaaa

SEQ ID NO: 551 - protein, 247 aa, Artificial Sequence
  ME62D11-HL
QVQLVQSGPEVVKPGASVKVSCKASGYTFTSYWLHWVKQAPGQGLEWIGMIDPSNSDTRFNPNFKDRATLTVDTSASTAYMLLSSLRSEDTAVYYCATYGSYVSPLDYWGQGTSVTVSSGGGGSGGGGSGGGGSDIVMTQTPSSLPVTLGETVSISCKSSQSLLYTSSQKNYLAWYLQKPGQSPQLLIYWASTRESGVPDRFSGSGSGTDFTLTISRVKAEDVAVYYCQQYYAYPWTFGGGTKLEIK

SEQ ID NO: 552 - DNA, 741 bp, Artificial Sequence
  ME62D11-HL
caggtgcagctggtccagtctgggcctgaagtggtgaagcctggggcttcagtgaaagtgtcctgcaaggcttcgggctataccttcaccagctactggttgcactgggttaaacaggcgcctggacaagggcttgagtggataggcatgattgatccttccaatagtgacactaggtttaatccgaacttcaaggacagggccacattgactgtagacacatctgccagcacagcctacatgctactcagcagcctgagatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccatcctccctacctgtgacacttggagagacggtttctatcagctgcaagtccagtcagtcccttttatatactagcagtcagaagaactacttggcctggtacctgcagaaaccaggtcagtctcctcaactgctgatttactgggcatccactagggaatctggggtccctgatcgcttctcaggcagtggatctgggacagatttcactctcacaatctccagagtgaaggctgaggacgtggcagtttattactgtcagcaatattatgcctatccgtggacgttcggtggaggcacaaagttggagatcaaa

SEQ ID NO: 553 - protein, 502 aa, Artificial Sequence
  ME62D11 HL x I2C HL
QVQLVQSGPEVVKPGASVKVSCKASGYTFTSYWLHWVKQAPGQGLEWIGMIDPSNSDTRFNPNFKDRATLTVDTSASTAYMLLSSLRSEDTAVYYCATYGSYVSPLDYWGQGTSVTVSSGGGGSGGGGSGGGGSDIVMTQTPSSLPVTLGETVSISCKSSQSLLYTSSQKNYLAWYLQKPGQSPQLLIYWASTRESGVPDRFSGSGSGTDFTLTISRVKAEDVAVYYCQQYYAYPWTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 554 - DNA, 1506 bp, Artificial Sequence
  ME62D11 HL x I2C HL
caggtgcagctggtccagtctgggcctgaagtggtgaagcctggggcttcagtgaaagtgtcctgcaaggcttcgggctataccttcaccagctactggttgcactgggttaaacaggcgcctggacaagggcttgagtggataggcatgattgatccttccaatagtgacactaggtttaatccgaacttcaaggacagggccacattgactgtagacacatctgccagcacagcctacatgctactcagcagcctgagatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccatcctccctacctgtgacacttggagagacggtttctatcagctgcaagtccagtcagtcccttttatatactagcagtcagaagaactacttggcctggtacctgcagaaaccaggtcagtctcctcaactgctgatttactgggcatccactagggaatctggggtccctgatcgcttctcaggcagtggatctgggacagatttcactctcacaatctccagagtgaaggctgaggacgtggcagtttattactgtcagcaatattatgcctatccgtggacgttcggtggaggcacaaagttggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 555 - protein, 119 aa, Artificial Sequence
  ME62C10-H
QVQLVQSGAELKKPGASVKVSCKASGYTFTSYWLHWVKQAPGQRLEWIGMIDPSNSDTRFNPNFKDRVTITVDTSANTAYMELSSLRSEDTAVYYCATYGSYVSPLDYWGQGTSVTVSS

SEQ ID NO: 556 - protein, 5 aa, Artificial Sequence
  ME62C10-HCDR1
SYWLH

SEQ ID NO: 557 - protein, 17 aa, Artificial Sequence
  ME62C10-HCDR2
MIDPSNSDTRFNPNFKD

SEQ ID NO: 558 - protein, 10 aa, Artificial Sequence
  ME62C10-HCDR3
YGSYVSPLDY

SEQ ID NO: 559 - DNA, 357 bp, Artificial Sequence
  ME62C10-H
caggtgcagctggtccagtctggggctgaactgaagaagcctggggcttcagtgaaagtgtcctgcaaggcttcgggctataccttcaccagctactggttgcactgggttaaacaggcgcctggacaaaggcttgagtggataggcatgattgatccttccaatagtgacactaggtttaatccgaacttcaaggacagggtcacaatcactgtagacacatctgccaacacagcctacatggagctcagcagcctgagatctgaggacactgcagtctattactgtgccacatatggtagctacgtttcccctctggactactggggtcaaggaacctcggtcaccgtctcctca

SEQ ID NO: 560 - protein, 113 aa, Artificial Sequence
  ME62C10-L
DIVMTQTPPSLTVTPGEQVSISCKSSQSLLYTSSQKNYLAWYLQKPGQSPKLLIYWASTRESGVPDRFSGSGSGTDFTLKISSVEADDVGVYYCQQYYAYPWTFGGGTKLEIK

SEQ ID NO: 561 - protein, 17 aa, Artificial Sequence
  ME62C10-LCDR1
KSSQSLLYTSSQKNYLA

SEQ ID NO: 562 - protein, 7 aa, Artificial Sequence
  ME62C10-LCDR2
WASTRES

SEQ ID NO: 563 - protein, 9 aa, Artificial Sequence
  ME62C10-LCDR3
QQYYAYPWT

SEQ ID NO: 564 - DNA, 339 bp, Artificial Sequence
  ME62C10-L
gacatcgtgatgacccagactccaccctccctaactgtgacacctggagagcaggtttctatcagctgcaagtccagtcagtcccttttatatactagcagtcagaagaactacttggcctggtacctgcagaaaccaggtcagtctcctaaactgctgatttactgggcatccactagggaatctggggtccctgatcgcttctcaggcagtggatctgggacagatttcactctcaaaatctccagtgtggaggctgacgacgtgggagtttattactgtcagcaatattatgcctatccgtggacgttcggtggaggcacaaagttggagatcaaa

SEQ ID NO: 565 - protein, 247 aa, Artificial Sequence
  ME62C10-HL
QVQLVQSGAELKKPGASVKVSCKASGYTFTSYWLHWVKQAPGQRLEWIGMIDPSNSDTRFNPNFKDRVTITVDTSANTAYMELSSLRSEDTAVYYCATYGSYVSPLDYWGQGTSVTVSSGGGGSGGGGSGGGGSDIVMTQTPPSLTVTPGEQVSISCKSSQSLLYTSSQKNYLAWYLQKPGQSPKLLIYWASTRESGVPDRFSGSGSGTDFTLKISSVEADDVGVYYCQQYYAYPWTFGGGTKLEIK

SEQ ID NO: 566 - DNA, 741 bp, Artificial Sequence
  ME62C10-HL
caggtgcagctggtccagtctggggctgaactgaagaagcctggggcttcagtgaaagtgtcctgcaaggcttcgggctataccttcaccagctactggttgcactgggttaaacaggcgcctggacaaaggcttgagtggataggcatgattgatccttccaatagtgacactaggtttaatccgaacttcaaggacagggtcacaatcactgtagacacatctgccaacacagcctacatggagctcagcagcctgagatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccaccctccctaactgtgacacctggagagcaggtttctatcagctgcaagtccagtcagtcccttttatatactagcagtcagaagaactacttggcctggtacctgcagaaaccaggtcagtctcctaaactgctgatttactgggcatccactagggaatctggggtccctgatcgcttctcaggcagtggatctgggacagatttcactctcaaaatctccagtgtggaggctgacgacgtgggagtttattactgtcagcaatattatgcctatccgtggacgttcggtggaggcacaaagttggagatcaaa

SEQ ID NO: 567 - protein, 502 aa, Artificial Sequence
  ME62C10 HL x I2C HL
QVQLVQSGAELKKPGASVKVSCKASGYTFTSYWLHWVKQAPGQRLEWIGMIDPSNSDTRFNPNFKDRVTITVDTSANTAYMELSSLRSEDTAVYYCATYGSYVSPLDYWGQGTSVTVSSGGGGSGGGGSGGGGSDIVMTQTPPSLTVTPGEQVSISCKSSQSLLYTSSQKNYLAWYLQKPGQSPKLLIYWASTRESGVPDRFSGSGSGTDFTLKISSVEADDVGVYYCQQYYAYPWTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 568 - DNA, 1506 bp, Artificial Sequence
  ME62C10 HL x I2C HL
caggtgcagctggtccagtctggggctgaactgaagaagcctggggcttcagtgaaagtgtcctgcaaggcttcgggctataccttcaccagctactggttgcactgggttaaacaggcgcctggacaaaggcttgagtggataggcatgattgatccttccaatagtgacactaggtttaatccgaacttcaaggacagggtcacaatcactgtagacacatctgccaacacagcctacatggagctcagcagcctgagatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccaccctccctaactgtgacacctggagagcaggtttctatcagctgcaagtccagtcagtcccttttatatactagcagtcagaagaactacttggcctggtacctgcagaaaccaggtcagtctcctaaactgctgatttactgggcatccactagggaatctggggtccctgatcgcttctcaggcagtggatctgggacagatttcactctcaaaatctccagtgtggaggctgacgacgtgggagtttattactgtcagcaatattatgcctatccgtggacgttcggtggaggcacaaagttggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 569 - protein, 119 aa, Artificial Sequence
  ME62A4-H
QVQLVQSGAEVMKPGASVKVSCRASGYTFTSYWLHWVRQAPGQGLEWIGMIDPSNSDTRFNPNFKDRVTMTVDTSSSTAYMELSSLRSEDTAVYYCATYGSYVSPLDYWGQGTSVTVSS

SEQ ID NO: 570 - protein, 5 aa, Artificial Sequence
  ME62A4-HCDR1
SYWLH

SEQ ID NO: 571 - protein, 17 aa, Artificial Sequence
  ME62A4-HCDR2
MIDPSNSDTRFNPNFKD

SEQ ID NO: 572 - protein, 10 aa, Artificial Sequence
  ME62A4-HCDR3
YGSYVSPLDY

SEQ ID NO: 573 - DNA, 357 bp, Artificial Sequence
  ME62A4-H
caggtgcagctggtccagtctggggctgaagtgatgaagcctggggcttcagtgaaagtgtcctgcagggcttcgggctataccttcaccagctactggttgcactgggttagacaggcgcctggacaagggcttgagtggataggcatgattgatccttccaatagtgacactaggtttaatccgaacttcaaggacagggtcacaatgactgtagacacatcttccagcacagcctacatggagctcagcagcctgagatctgaggacactgcagtctattactgtgccacatatggtagctacgtttcccctctggactactggggtcaaggaacctcggtcaccgtctcctca

SEQ ID NO: 574 - protein, 113 aa, Artificial Sequence
  ME62A4-L
DIVMTQTPFSLPVTAGETVSISCKSSQSLLYTSSQKNYLAWYLQKPGQSPQLLIYWASTRESGVPDRFSGSGSGTDFTLKISRVEAEDVGVYYCQQYYAYPWTFGGGTKLEIK

SEQ ID NO: 575 - protein, 17 aa, Artificial Sequence
  ME62A4-LCDR1
KSSQSLLYTSSQKNYLA

SEQ ID NO: 576 - protein, 7 aa, Artificial Sequence
  ME62A4-LCDR2
WASTRES

SEQ ID NO: 577 - protein, 9 aa, Artificial Sequence
  ME62A4-LCDR3
QQYYAYPWT

SEQ ID NO: 578 - DNA, 339 bp, Artificial Sequence
  ME62A4-L
gacatcgtgatgacccagactccattctccctacctgtgacagctggagagacggtttctatcagctgcaagtccagtcagtcccttttatatactagcagtcagaagaactacttggcctggtacctgcagaaaccaggtcagtctcctcaactgctgatttactgggcatccactagggaatctggggtccctgatcgcttctcaggcagtggatctgggacagatttcactctcaaaatctccagagtggaggctgaggacgtgggagtttattactgtcagcaatattatgcctatccgtggacgttcggtggaggcacaaagttggagatcaaa

SEQ ID NO: 579 - protein, 247 aa, Artificial Sequence
  ME62A4-HL
QVQLVQSGAEVMKPGASVKVSCRASGYTFTSYWLHWVRQAPGQGLEWIGMIDPSNSDTRFNPNFKDRVTMTVDTSSSTAYMELSSLRSEDTAVYYCATYGSYVSPLDYWGQGTSVTVSSGGGGSGGGGSGGGGSDIVMTQTPFSLPVTAGETVSISCKSSQSLLYTSSQKNYLAWYLQKPGQSPQLLIYWASTRESGVPDRFSGSGSGTDFTLKISRVEAEDVGVYYCQQYYAYPWTFGGGTKLEIK

SEQ ID NO: 580 - DNA, 741 bp, Artificial Sequence
  ME62A4-HL
caggtgcagctggtccagtctggggctgaagtgatgaagcctggggcttcagtgaaagtgtcctgcagggcttcgggctataccttcaccagctactggttgcactgggttagacaggcgcctggacaagggcttgagtggataggcatgattgatccttccaatagtgacactaggtttaatccgaacttcaaggacagggtcacaatgactgtagacacatcttccagcacagcctacatggagctcagcagcctgagatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccattctccctacctgtgacagctggagagacggtttctatcagctgcaagtccagtcagtcccttttatatactagcagtcagaagaactacttggcctggtacctgcagaaaccaggtcagtctcctcaactgctgatttactgggcatccactagggaatctggggtccctgatcgcttctcaggcagtggatctgggacagatttcactctcaaaatctccagagtggaggctgaggacgtgggagtttattactgtcagcaatattatgcctatccgtggacgttcggtggaggcacaaagttggagatcaaa

SEQ ID NO: 581 - protein, 502 aa, Artificial Sequence
  ME62A4 HL x I2C HL
QVQLVQSGAEVMKPGASVKVSCRASGYTFTSYWLHWVRQAPGQGLEWIGMIDPSNSDTRFNPNFKDRVTMTVDTSSSTAYMELSSLRSEDTAVYYCATYGSYVSPLDYWGQGTSVTVSSGGGGSGGGGSGGGGSDIVMTQTPFSLPVTAGETVSISCKSSQSLLYTSSQKNYLAWYLQKPGQSPQLLIYWASTRESGVPDRFSGSGSGTDFTLKISRVEAEDVGVYYCQQYYAYPWTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 582 - DNA, 1506 bp, Artificial Sequence
  ME62A4 HL x I2C HL
caggtgcagctggtccagtctggggctgaagtgatgaagcctggggcttcagtgaaagtgtcctgcagggcttcgggctataccttcaccagctactggttgcactgggttagacaggcgcctggacaagggcttgagtggataggcatgattgatccttccaatagtgacactaggtttaatccgaacttcaaggacagggtcacaatgactgtagacacatcttccagcacagcctacatggagctcagcagcctgagatctgaggacactgcagtctattactgtgccacatatggtagctacgtttcccctctggactactggggtcaaggaacctcggtcaccgtctcctcaggtggtggtggttctggcggcggcggctccggtggtggtggttctgacatcgtgatgacccagactccattctccctacctgtgacagctggagagacggtttctatcagctgcaagtccagtcagtcccttttatatactagcagtcagaagaactacttggcctggtacctgcagaaaccaggtcagtctcctcaactgctgatttactgggcatccactagggaatctggggtccctgatcgcttctcaggcagtggatctgggacagatttcactctcaaaatctccagagtggaggctgaggacgtgggagtttattactgtcagcaatattatgcctatccgtggacgttcggtggaggcacaaagttggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 583 - protein, 126 aa, Mus musculus
EVQLLEQSGAELVRPGTSVKMSCKAAGYTFTKYWIGWVKQRPGHGLEWIGDIHPGGGYANYNEKFKGKATLTADTSSSTAYMQLSRLTSDDSAIYYCARSGYDYGSSYDYHGMDFWGQGTTVTVSS

SEQ ID NO: 584 - protein, 5 aa, Mus musculus
KYWIG

SEQ ID NO: 585 - protein, 17 aa, Mus musculus
DIHPGGGYANYNEKFKG

SEQ ID NO: 586 - protein, 16 aa, Mus musculus
SGYDYGSSYDYHGMDF

SEQ ID NO: 587 - DNA, 378 bp, Mus musculus
gaggtgcagctgctcgagcagtctggagctgagctggttaggcctgggacttcagtgaagatgtcctgcaaggctgctggatacaccttcactaagtactggataggttgggtaaagcagaggcctggacatggccttgagtggattggagatattcaccctggaggtggttatgctaactacaatgagaagttcaagggcaaggccacactgactgcagacacatcctccagcacagcctacatgcagctcagcagactgacatctgatgactccgccatctattactgtgcaagatcggggtatgactacggtagtagttacgattaccatggtatggacttctggggccaagggaccacggtcaccgtctcctca

SEQ ID NO: 588 - protein, 107 aa, Mus musculus
ELQMTQSPASLSASVGEPVTFTCRASENIYSYLAWYQQKQGKSPQLLIYGATNLADGMSSRFSGSGSGRQYSLKISSLHPDDVATYYCQNVLSTPYTFGGGTKLEIK

SEQ ID NO: 589 - protein, 11 aa, Mus musculus
RASENIYSYLA

SEQ ID NO: 590 - protein, 7 aa, Mus musculus
GATNLAD

SEQ ID NO: 591 - protein, 9 aa, Mus musculus
QNVLSTPYT

SEQ ID NO: 592 - DNA, 321 bp, Mus musculus
gagctccagatgacccagtctccagcctccctatctgcatctgtgggagaacctgtcaccttcacatgtcgagcaagtgagaatatttacagttatttagcatggtatcagcagaaacagggaaaatctcctcagctcctgatctatggtgcaaccaacttggcagatggcatgtcatcgaggttcagtggcagtggatctggtagacagtattctctcaagatcagtagcctgcatcctgacgatgttgcaacgtattactgtcaaaatgtgttaagtactccgtacacgttcggaggggggaccaagcttgagatcaaa

SEQ ID NO: 593 - protein, 248 aa, Mus musculus
EVQLLEQSGAELVRPGTSVKMSCKAAGYTFTKYWIGWVKQRPGHGLEWIGDIHPGGGYANYNEKFKGKATLTADTSSSTAYMQLSRLTSDDSAIYYCARSGYDYGSSYDYHGMDFWGQGTTVTVSSGGGGSGGGGSGGGGSELQMTQSPASLSASVGEPVTFTCRASENIYSYLAWYQQKQGKSPQLLIYGATNLADGMSSRFSGSGSGRQYSLKISSLHPDDVATYYCQNVLSTPYTFGGGTKLEIK

SEQ ID NO: 594 - DNA, 744 bp, Mus musculus
gaggtgcagctgctcgagcagtctggagctgagctggttaggcctgggacttcagtgaagatgtcctgcaaggctgctggatacaccttcactaagtactggataggttgggtaaagcagaggcctggacatggccttgagtggattggagatattcaccctggaggtggttatgctaactacaatgagaagttcaagggcaaggccacactgactgcagacacatcctccagcacagcctacatgcagctcagcagactgacatctgatgactccgccatctattactgtgcaagatcggggtatgactacggtagtagttacgattaccatggtatggacttctggggccaagggaccacggtcaccgtctcctcaggtggtggtggttctggcggcggcggctccggtggtggtggttctgagctccagatgacccagtctccagcctccctatctgcatctgtgggagaacctgtcaccttcacatgtcgagcaagtgagaatatttacagttatttagcatggtatcagcagaaacagggaaaatctcctcagctcctgatctatggtgcaaccaacttggcagatggcatgtcatcgaggttcagtggcagtggatctggtagacagtattctctcaagatcagtagcctgcatcctgacgatgttgcaacgtattactgtcaaaatgtgttaagtactccgtacacgttcggaggggggaccaagcttgagatcaaa

SEQ ID NO: 595 - protein, 503 aa, Mus musculus
EVQLLEQSGAELVRPGTSVKMSCKAAGYTFTKYWIGWVKQRPGHGLEWIGDIHPGGGYANYNEKFKGKATLTADTSSSTAYMQLSRLTSDDSAIYYCARSGYDYGSSYDYHGMDFWGQGTTVTVSSGGGGSGGGGSGGGGSELQMTQSPASLSASVGEPVTFTCRASENIYSYLAWYQQKQGKSPQLLIYGATNLADGMSSRFSGSGSGRQYSLKISSLHPDDVATYYCQNVLSTPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 596 - DNA, 1509 bp, Mus musculus
gaggtgcagctgctcgagcagtctggagctgagctggttaggcctgggacttcagtgaagatgtcctgcaaggctgctggatacaccttcactaagtactggataggttgggtaaagcagaggcctggacatggccttgagtggattggagatattcaccctggaggtggttatgctaactacaatgagaagttcaagggcaaggccacactgactgcagacacatcctccagcacagcctacatgcagctcagcagactgacatctgatgactccgccatctattactgtgcaagatcggggtatgactacggtagtagttacgattaccatggtatggacttctggggccaagggaccacggtcaccgtctcctcaggtggtggtggttctggcggcggcggctccggtggtggtggttctgagctccagatgacccagtctccagcctccctatctgcatctgtgggagaacctgtcaccttcacatgtcgagcaagtgagaatatttacagttatttagcatggtatcagcagaaacagggaaaatctcctcagctcctgatctatggtgcaaccaacttggcagatggcatgtcatcgaggttcagtggcagtggatctggtagacagtattctctcaagatcagtagcctgcatcctgacgatgttgcaacgtattactgtcaaaatgtgttaagtactccgtacacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 597 - protein, 127 aa, Mus musculus
EVQLLEQSGAELVRPGTSVKISCKATGYTFSNYWISWVKYRPGHGLEWIGDIYPGGSYTNYNEKFKGKVTLTADTSSRTAYMQLSGLTFEDSAIYYCARSGYDYGSDYDYHGMDYWGQGTTVTVSSG

SEQ ID NO: 598 - protein, 5 aa, Mus musculus
NYWIS

SEQ ID NO: 599 - protein, 17 aa, Mus musculus
DIYPGGSYTNYNEKFKG

SEQ ID NO: 600 - protein, 16 aa, Mus musculus
SGYDYGSDYDYHGMDY

SEQ ID NO: 601 - DNA, 378 bp, Mus musculus
gaggtgcagctgctcgagcagtctggagctgagctggtaaggcctgggacttcagtgaagatttcctgcaaggctactgggtacaccttcagtaattactggataagttgggtaaagtataggcctggacatggtcttgagtggattggagatatttaccctggaggcagttatactaattacaatgagaaattcaagggcaaggtcacactgactgcagacacatcctccaggacagcctacatgcagctcagcggcctgacatttgaggactctgccatctactactgtgcaagatcggggtatgactacggtagtgactacgattaccatggtatggactactggggccaagggaccacggtcaccgtctcctca

SEQ ID NO: 602 - protein, 107 aa, Mus musculus
ELQMTQSPASLSASVGETVTITCRASENIYSNLAWYQQKQGKSPQLLVYAATNLADGVPSRFSGSRSGSDYSLTISSLESEDFVDYYCLQYASYPYTFGGGTKLEIK

SEQ ID NO: 603 - protein, 11 aa, Mus musculus
RASENIYSNLA

SEQ ID NO: 604 - protein, 7 aa, Mus musculus
AATNLAD

SEQ ID NO: 605 - protein, 9 aa, Mus musculus
LQYASYPYT

SEQ ID NO: 606 - DNA, 321 bp, Mus musculus
gagctccagatgacccagtctccagcctccctatctgcatctgtgggagaaactgtcaccatcacatgtcgagcaagtgagaatatttacagtaatttagcatggtatcagcagaaacagggaaaatctcctcagctcctggtctatgctgcaacaaacttagcagatggtgtgccatcaaggttcagtggcagtaggtctgggtcagattattctctcaccatcagcagccttgagtctgaagattttgtagactattactgtctacaatatgctagttatccgtacacgttcggaggggggaccaagcttgagatcaaa

SEQ ID NO: 607 - protein, 248 aa, Mus musculus
EVQLLEQSGAELVRPGTSVKISCKATGYTFSNYWISWVKYRPGHGLEWIGDIYPGGSYTNYNEKFKGKVTLTADTSSRTAYMQLSGLTFEDSAIYYCARSGYDYGSDYDYHGMDYWGQGTTVTVSSGGGGSGGGGSGGGGSELQMTQSPASLSASVGETVTITCRASENIYSNLAWYQQKQGKSPQLLVYAATNLADGVPSRFSGSRSGSDYSLTISSLESEDFVDYYCLQYASYPYTFGGGTKLEIK

SEQ ID NO: 608 - DNA, 744 bp, Mus musculus
gaggtgcagctgctcgagcagtctggagctgagctggtaaggcctgggacttcagtgaagatttcctgcaaggctactgggtacaccttcagtaattactggataagttgggtaaagtataggcctggacatggtcttgagtggattggagatatttaccctggaggcagttatactaattacaatgagaaattcaagggcaaggtcacactgactgcagacacatcctccaggacagcctacatgcagctcagcggcctgacatttgaggactctgccatctactactgtgcaagatcggggtatgactacggtagtgactacgattaccatggtatggactactggggccaagggaccacggtcaccgtctcctcaggtggtggtggttctggcggcggcggctccggtggtggtggttctgagctccagatgacccagtctccagcctccctatctgcatctgtgggagaaactgtcaccatcacatgtcgagcaagtgagaatatttacagtaatttagcatggtatcagcagaaacagggaaaatctcctcagctcctggtctatgctgcaacaaacttagcagatggtgtgccatcaaggttcagtggcagtaggtctgggtcagattattctctcaccatcagcagccttgagtctgaagattttgtagactattactgtctacaatatgctagttatccgtacacgttcggaggggggaccaagcttgagatcaaa

SEQ ID NO: 609 - protein, 503 aa, Mus musculus
EVQLLEQSGAELVRPGTSVKISCKATGYTFSNYWISWVKYRPGHGLEWIGDIYPGGSYTNYNEKFKGKVTLTADTSSRTAYMQLSGLTFEDSAIYYCARSGYDYGSDYDYHGMDYWGQGTTVTVSSGGGGSGGGGSGGGGSELQMTQSPASLSASVGETVTITCRASENIYSNLAWYQQKQGKSPQLLVYAATNLADGVPSRFSGSRSGSDYSLTISSLESEDFVDYYCLQYASYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 610 - DNA, 1509 bp, Mus musculus
gaggtgcagctgctcgagcagtctggagctgagctggtaaggcctgggacttcagtgaagatttcctgcaaggctactgggtacaccttcagtaattactggataagttgggtaaagtataggcctggacatggtcttgagtggattggagatatttaccctggaggcagttatactaattacaatgagaaattcaagggcaaggtcacactgactgcagacacatcctccaggacagcctacatgcagctcagcggcctgacatttgaggactctgccatctactactgtgcaagatcggggtatgactacggtagtgactacgattaccatggtatggactactggggccaagggaccacggtcaccgtctcctcaggtggtggtggttctggcggcggcggctccggtggtggtggttctgagctccagatgacccagtctccagcctccctatctgcatctgtgggagaaactgtcaccatcacatgtcgagcaagtgagaatatttacagtaatttagcatggtatcagcagaaacagggaaaatctcctcagctcctggtctatgctgcaacaaacttagcagatggtgtgccatcaaggttcagtggcagtaggtctgggtcagattattctctcaccatcagcagccttgagtctgaagattttgtagactattactgtctacaatatgctagttatccgtacacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 611 - protein, 126 aa, Mus musculus
EVQLLEQSGAELVRPGTSVKISCKTTGYTFGYYWISWLKQRPGHGLEWIGDIYPGGGYTNYHEKFKGKVTLTADTSSRTAYMQLSSLTFEDSAIYYCARSGYDYGSDYDYHGMDYWGQGTTVTVSS

SEQ ID NO: 612 - protein, 5 aa, Mus musculus
YYWIS

SEQ ID NO: 613 - protein, 17 aa, Mus musculus
DIYPGGGYTNYHEKFKG

SEQ ID NO: 614 - protein, 16 aa, Mus musculus
SGYDYGSDYDYHGMDY

SEQ ID NO: 615 - DNA, 378 bp, Mus musculus
gaggtgcagctgctcgagcagtctggagctgagctggttaggcctgggacttcagtgaagatttcctgcaagactactgggtacaccttcggttattactggataagttggttaaagcagaggcctggacatggccttgagtggattggagatatttaccctggaggtggttacactaactaccatgagaaattcaagggcaaggtcacactgactgcagacacatcctccaggacagcctacatgcagctcagcagcctgacatttgaggactctgccatctattactgtgcaagatcgggatatgactacggtagtgactacgattatcatggtatggattactggggccaagggaccacggtcaccgtctcctca

SEQ ID NO: 616 - protein, 107 aa, Mus musculus
ELVMTQTPSSLSASLGDRVTISCRASQGISNYLNWYQQKPDGSVKLLIYYTSRLHSGVPSRFSGSGSGTDYSLTISNLDQEDIATYFCQQGNTLPWTFGGGTKLEIK

SEQ ID NO: 617 - protein, 11 aa, Mus musculus
RASQGISNYLN

SEQ ID NO: 618 - protein, 7 aa, Mus musculus
YTSRLHS

SEQ ID NO: 619 - protein, 7 aa, Mus musculus
QQGNTLP

SEQ ID NO: 620 - DNA, 321 bp, Mus musculus
gagctcgtgatgacccagactccatcctccctgtctgcctctctgggagacagagtcaccatcagttgcagggcaagtcagggcattagcaattatttaaactggtatcagcagaaaccagatggatctgttaaactcctgatctactacacatcaagattacactcaggagtcccatcaaggttcagtggcagtgggtctggaacagattattctctcaccattagcaacctggatcaagaagatattgccacttacttttgccaacagggtaatacgcttccgtggacgttcggaggggggaccaagcttgagatcaaa

SEQ ID NO: 621 - protein, 248 aa, Mus musculus
EVQLLEQSGAELVRPGTSVKISCKTTGYTFGYYWISWLKQRPGHGLEWIGDIYPGGGYTNYHEKFKGKVTLTADTSSRTAYMQLSSLTFEDSAIYYCARSGYDYGSDYDYHGMDYWGQGTTVTVSSGGGGSGGGGSGGGGSELVMTQTPSSLSASLGDRVTISCRASQGISNYLNWYQQKPDGSVKLLIYYTSRLHSGVPSRFSGSGSGTDYSLTISNLDQEDIATYFCQQGNTLPWTFGGGTKLEIK

SEQ ID NO: 622 - DNA, 744 bp, Mus musculus
gaggtgcagctgctcgagcagtctggagctgagctggttaggcctgggacttcagtgaagatttcctgcaagactactgggtacaccttcggttattactggataagttggttaaagcagaggcctggacatggccttgagtggattggagatatttaccctggaggtggttacactaactaccatgagaaattcaagggcaaggtcacactgactgcagacacatcctccaggacagcctacatgcagctcagcagcctgacatttgaggactctgccatctattactgtgcaagatcgggatatgactacggtagtgactacgattatcatggtatggattactggggccaagggaccacggtcaccgtctcctcaggtggtggtggttctggcggcggcggctccggtggtggtggttctgagctcgtgatgacccagactccatcctccctgtctgcctctctgggagacagagtcaccatcagttgcagggcaagtcagggcattagcaattatttaaactggtatcagcagaaaccagatggatctgttaaactcctgatctactacacatcaagattacactcaggagtcccatcaaggttcagtggcagtgggtctggaacagattattctctcaccattagcaacctggatcaagaagatattgccacttacttttgccaacagggtaatacgcttccgtggacgttcggaggggggaccaagcttgagatcaaa

SEQ ID NO: 623 - protein, 503 aa, Mus musculus
EVQLLEQSGAELVRPGTSVKISCKTTGYTFGYYWISWLKQRPGHGLEWIGDIYPGGGYTNYHEKFKGKVTLTADTSSRTAYMQLSSLTFEDSAIYYCARSGYDYGSDYDYHGMDYWGQGTTVTVSSGGGGSGGGGSGGGGSELVMTQTPSSLSASLGDRVTISCRASQGISNYLNWYQQKPDGSVKLLIYYTSRLHSGVPSRFSGSGSGTDYSLTISNLDQEDIATYFCQQGNTLPWTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 624 - DNA, 1509 bp, Mus musculus
gaggtgcagctgctcgagcagtctggagctgagctggttaggcctgggacttcagtgaagatttcctgcaagactactgggtacaccttcggttattactggataagttggttaaagcagaggcctggacatggccttgagtggattggagatatttaccctggaggtggttacactaactaccatgagaaattcaagggcaaggtcacactgactgcagacacatcctccaggacagcctacatgcagctcagcagcctgacatttgaggactctgccatctattactgtgcaagatcgggatatgactacggtagtgactacgattatcatggtatggattactggggccaagggaccacggtcaccgtctcctcaggtggtggtggttctggcggcggcggctccggtggtggtggttctgagctcgtgatgacccagactccatcctccctgtctgcctctctgggagacagagtcaccatcagttgcagggcaagtcagggcattagcaattatttaaactggtatcagcagaaaccagatggatctgttaaactcctgatctactacacatcaagattacactcaggagtcccatcaaggttcagtggcagtgggtctggaacagattattctctcaccattagcaacctggatcaagaagatattgccacttacttttgccaacagggtaatacgcttccgtggacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 625 - protein, 126 aa, Mus musculus
EVQLLEQSGAEVVRPGTSVKMSCKAAGYTFTKYWIGWVKQRPGHGLEWIGDIHPGGGFANYNEKFKGKATLTADTSSSTAYMQLSRLTSDDSAIYYCARSGYDYGSSYDYHGMDYWGQGTTVTVSS

SEQ ID NO: 626 - protein, 5 aa, Mus musculus
KYWIG

SEQ ID NO: 627 - protein, 17 aa, Mus musculus
DIHPGGGFANYNEKFKG

SEQ ID NO: 628 - protein, 16 aa, Mus musculus
SGYDYGSSYDYHGMDY

SEQ ID NO: 629 - DNA, 378 bp, Mus musculus
gaggtgcagctgctcgagcagtctggagctgaggtggttaggcctgggacttcagtgaagatgtcctgcaaggctgctggatacaccttcactaagtactggataggttgggtaaagcagaggcctggacatggccttgagtggattggagatattcaccctggaggtggttttgctaactacaatgagaagttcaagggcaaggccacactgactgcagacacatcctccagcacagcctacatgcagctcagcagactgacatctgatgactctgccatctattactgtgcaagatcgggttatgactacggtagtagttacgattaccatggtatggactactggggccaagggaccacggtcaccgtctcctca

SEQ ID NO: 630 - protein, 107 aa, Mus musculus
ELVMTQSPSSLSASLGERVSLTCRASQEISGYLSWLQQKPDGTIKRLIYAASTLDSGVPKRFSGSRSGSDYSLTISSLESEDFADYYCLQYASYPPTFGGGTKLEIK

SEQ ID NO: 631 - protein, 11 aa, Mus musculus
RASQEISGYLS

SEQ ID NO: 632 - protein, 7 aa, Mus musculus
AASTLDS

SEQ ID NO: 633 - protein, 9 aa, Mus musculus
LQYASYPPT

SEQ ID NO: 634 - DNA, 321 bp, Mus musculus
gagctcgtgatgacacagtctccatcctccttatctgcctctctgggagaaagagtcagtctcacttgtcgggcaagtcaggaaattagtggttacttaagctggcttcagcagaaaccagatggaactattaaacgcctgatctacgccgcatccactttagattctggtgtcccaaaaaggttcagtggcagtaggtctgggtcagattattctctcaccatcagcagccttgagtctgaagattttgcagactattactgtctacaatatgctagttatcctcccacgttcggaggggggaccaagcttgagatcaaa

SEQ ID NO: 635 - protein, 248 aa, Mus musculus
EVQLLEQSGAEVVRPGTSVKMSCKAAGYTFTKYWIGWVKQRPGHGLEWIGDIHPGGGFANYNEKFKGKATLTADTSSSTAYMQLSRLTSDDSAIYYCARSGYDYGSSYDYHGMDYWGQGTTVTVSSGGGGSGGGGSGGGGSELVMTQSPSSLSASLGERVSLTCRASQEISGYLSWLQQKPDGTIKRLIYAASTLDSGVPKRFSGSRSGSDYSLTISSLESEDFADYYCLQYASYPPTFGGGTKLEIK

SEQ ID NO: 636 - DNA, 744 bp, Mus musculus
gaggtgcagctgctcgagcagtctggagctgaggtggttaggcctgggacttcagtgaagatgtcctgcaaggctgctggatacaccttcactaagtactggataggttgggtaaagcagaggcctggacatggccttgagtggattggagatattcaccctggaggtggttttgctaactacaatgagaagttcaagggcaaggccacactgactgcagacacatcctccagcacagcctacatgcagctcagcagactgacatctgatgactctgccatctattactgtgcaagatcgggttatgactacggtagtagttacgattaccatggtatggactactggggccaagggaccacggtcaccgtctcctcaggtggtggtggttctggcggcggcggctccggtggtggtggttctgagctcgtgatgacacagtctccatcctccttatctgcctctctgggagaaagagtcagtctcacttgtcgggcaagtcaggaaattagtggttacttaagctggcttcagcagaaaccagatggaactattaaacgcctgatctacgccgcatccactttagattctggtgtcccaaaaaggttcagtggcagtaggtctgggtcagattattctctcaccatcagcagccttgagtctgaagattttgcagactattactgtctacaatatgctagttatcctcccacgttcggaggggggaccaagcttgagatcaaa

SEQ ID NO: 637 - protein, 503 aa, Mus musculus
EVQLLEQSGAEVVRPGTSVKMSCKAAGYTFTKYWIGWVKQRPGHGLEWIGDIHPGGGFANYNEKFKGKATLTADTSSSTAYMQLSRLTSDDSAIYYCARSGYDYGSSYDYHGMDYWGQGTTVTVSSGGGGSGGGGSGGGGSELVMTQSPSSLSASLGERVSLTCRASQEISGYLSWLQQKPDGTIKRLIYAASTLDSGVPKRFSGSRSGSDYSLTISSLESEDFADYYCLQYASYPPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 638 - DNA, 1509 bp, Mus musculus
gaggtgcagctgctcgagcagtctggagctgaggtggttaggcctgggacttcagtgaagatgtcctgcaaggctgctggatacaccttcactaagtactggataggttgggtaaagcagaggcctggacatggccttgagtggattggagatattcaccctggaggtggttttgctaactacaatgagaagttcaagggcaaggccacactgactgcagacacatcctccagcacagcctacatgcagctcagcagactgacatctgatgactctgccatctattactgtgcaagatcgggttatgactacggtagtagttacgattaccatggtatggactactggggccaagggaccacggtcaccgtctcctcaggtggtggtggttctggcggcggcggctccggtggtggtggttctgagctcgtgatgacacagtctccatcctccttatctgcctctctgggagaaagagtcagtctcacttgtcgggcaagtcaggaaattagtggttacttaagctggcttcagcagaaaccagatggaactattaaacgcctgatctacgccgcatccactttagattctggtgtcccaaaaaggttcagtggcagtaggtctgggtcagattattctctcaccatcagcagccttgagtctgaagattttgcagactattactgtctacaatatgctagttatcctcccacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 639 - protein, 126 aa, Mus musculus
EVQLLEQSGAELVRPGTSVKIPCKATGYTFSYYWIGWVKQRPGHGLEWIGDIYPGGGYSNYNEKFKGKATLTADTSSSTAYMQLSGLTSEDSAIYYCARSGYDYGSDYDYHGLDYWGQGTTVTVSS

SEQ ID NO: 640 - protein, 5 aa, Mus musculus
YYWIG

SEQ ID NO: 641 - protein, 17 aa, Mus musculus
DIYPGGGYSNYNEKFKG

SEQ ID NO: 642 - protein, 16 aa, Mus musculus
SGYDYGSDYDYHGLDY

SEQ ID NO: 643 - DNA, 378 bp, Mus musculus
gaggtgcagctgctcgagcagtctggagctgaactggtaaggcctgggacttcagtgaagattccctgcaaggctactggatacaccttcagttattactggataggttgggtaaagcagaggcctggacatggccttgagtggattggagatatttaccctggaggtggttatagtaactacaatgagaaattcaagggaaaggccacactgactgcagacacatcctccagcacagcctacatgcagctcagcggcctgacatctgaggactctgccatctattactgtgcaagatcgggatatgactacggtagtgactacgattaccatggtctggactactggggccaagggaccacggtcaccgtctcctca

SEQ ID NO: 644 - protein, 111 aa, Mus musculus
ELVLTQSPASLAVSLGQRATISCRASESVEYYGTSLMQWYQQKPGQPPKLLIYAASNVESGVPARFSGSGSGTDFSLNIHPVEEDDIAMYFCQQSRKVPYTFGGGTKLEIK

SEQ ID NO: 645 - protein, 15 aa, Mus musculus
RASESVEYYGTSLMQ

SEQ ID NO: 646 - protein, 7 aa, Mus musculus
AASNVES

SEQ ID NO: 647 - protein, 9 aa, Mus musculus
QQSRKVPYT

SEQ ID NO: 648 - DNA, 333 bp, Mus musculus
gagctcgtgctcacccagtctccagcttctttggctgtgtctctagggcagagagccaccatctcctgcagagccagtgaaagtgttgaatattatggcacaagtttaatgcagtggtaccaacagaaaccaggacagccacccaaactcctcatctatgctgcatccaacgtagaatctggggtccctgccaggtttagtggcagtgggtctgggacagacttcagcctcaacatccatcctgtggaggaggatgatattgcaatgtatttctgtcagcaaagtaggaaggttccgtacacgttcggaggggggaccaagcttgagatcaaa

SEQ ID NO: 649 - protein, 252 aa, Mus musculus
EVQLLEQSGAELVRPGTSVKIPCKATGYTFSYYWIGWVKQRPGHGLEWIGDIYPGGGYSNYNEKFKGKATLTADTSSSTAYMQLSGLTSEDSAIYYCARSGYDYGSDYDYHGLDYWGQGTTVTVSSGGGGSGGGGSGGGGSELVLTQSPASLAVSLGQRATISCRASESVEYYGTSLMQWYQQKPGQPPKLLIYAASNVESGVPARFSGSGSGTDFSLNIHPVEEDDIAMYFCQQSRKVPYTFGGGTKLEIK

SEQ ID NO: 650 - DNA, 756 bp, Mus musculus
gaggtgcagctgctcgagcagtctggagctgaactggtaaggcctgggacttcagtgaagattccctgcaaggctactggatacaccttcagttattactggataggttgggtaaagcagaggcctggacatggccttgagtggattggagatatttaccctggaggtggttatagtaactacaatgagaaattcaagggaaaggccacactgactgcagacacatcctccagcacagcctacatgcagctcagcggcctgacatctgaggactctgccatctattactgtgcaagatcgggatatgactacggtagtgactacgattaccatggtctggactactggggccaagggaccacggtcaccgtctcctcaggtggtggtggttctggcggcggcggctccggtggtggtggttctgagctcgtgctcacccagtctccagcttctttggctgtgtctctagggcagagagccaccatctcctgcagagccagtgaaagtgttgaatattatggcacaagtttaatgcagtggtaccaacagaaaccaggacagccacccaaactcctcatctatgctgcatccaacgtagaatctggggtccctgccaggtttagtggcagtgggtctgggacagacttcagcctcaacatccatcctgtggaggaggatgatattgcaatgtatttctgtcagcaaagtaggaaggttccgtacacgttcggaggggggaccaagcttgagatcaaa

SEQ ID NO: 651 - protein, 507 aa, Mus musculus
EVQLLEQSGAELVRPGTSVKIPCKATGYTFSYYWIGWVKQRPGHGLEWIGDIYPGGGYSNYNEKFKGKATLTADTSSSTAYMQLSGLTSEDSAIYYCARSGYDYGSDYDYHGLDYWGQGTTVTVSSGGGGSGGGGSGGGGSELVLTQSPASLAVSLGQRATISCRASESVEYYGTSLMQWYQQKPGQPPKLLIYAASNVESGVPARFSGSGSGTDFSLNIHPVEEDDIAMYFCQQSRKVPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 652 - DNA, 1521 bp, Mus musculus
gaggtgcagctgctcgagcagtctggagctgaactggtaaggcctgggacttcagtgaagattccctgcaaggctactggatacaccttcagttattactggataggttgggtaaagcagaggcctggacatggccttgagtggattggagatatttaccctggaggtggttatagtaactacaatgagaaattcaagggaaaggccacactgactgcagacacatcctccagcacagcctacatgcagctcagcggcctgacatctgaggactctgccatctattactgtgcaagatcgggatatgactacggtagtgactacgattaccatggtctggactactggggccaagggaccacggtcaccgtctcctcaggtggtggtggttctggcggcggcggctccggtggtggtggttctgagctcgtgctcacccagtctccagcttctttggctgtgtctctagggcagagagccaccatctcctgcagagccagtgaaagtgttgaatattatggcacaagtttaatgcagtggtaccaacagaaaccaggacagccacccaaactcctcatctatgctgcatccaacgtagaatctggggtccctgccaggtttagtggcagtgggtctgggacagacttcagcctcaacatccatcctgtggaggaggatgatattgcaatgtatttctgtcagcaaagtaggaaggttccgtacacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 653 - protein, 126 aa, Mus musculus; identical to SEQ ID NO: 625

SEQ ID NO: 654 - protein, 5 aa, Mus musculus
KYWIG

SEQ ID NO: 655 - protein, 17 aa, Mus musculus
DIHPGGGFANYNEKFKG

SEQ ID NO: 656 - protein, 16 aa, Mus musculus
SGYDYGSSYDYHGMDY

SEQ ID NO: 657 - DNA, 378 bp, Mus musculus; identical to SEQ ID NO: 629

SEQ ID NO: 658 - protein, 111 aa, Mus musculus
ELQMTQSPTSLAVSLGQRATISCRASQTVYYDGNNYMNWYQHKPGQPPKLLIYATSNLESGIPARFSGSGSGTDFTLNIHPVEAEDAATYYCQQSYEDPYTFGGGTKLEIK

SEQ ID NO: 659 - protein, 15 aa, Mus musculus
RASQTVYYDGNNYMN

SEQ ID NO: 660 - protein, 7 aa, Mus musculus
ATSNLES

SEQ ID NO: 661 - protein, 9 aa, Mus musculus
QQSYEDPYT

SEQ ID NO: 662 - DNA, 333 bp, Mus musculus
gagctccagatgacccagtctccaacttctttggctgtgtctctcgggcagagggccaccatctcctgcagggccagccaaactgtttactatgatggtaataattatatgaactggtatcaacacaaaccaggacagccacccaaactcctcatctatgctacatccaatctagaatctgggatcccagccaggtttagtggcagtgggtctgggacagacttcaccctcaacatccatcctgtggaggcggaggatgctgcaacctattactgtcagcaaagttatgaggatccgtacacgttcggaggggggaccaagcttgagatcaaa

SEQ ID NO: 663 - protein, 252 aa, Mus musculus
EVQLLEQSGAEVVRPGTSVKMSCKAAGYTFTKYWIGWVKQRPGHGLEWIGDIHPGGGFANYNEKFKGKATLTADTSSSTAYMQLSRLTSDDSAIYYCARSGYDYGSSYDYHGMDYWGQGTTVTVSSGGGGSGGGGSGGGGSELQMTQSPTSLAVSLGQRATISCRASQTVYYDGNNYMNWYQHKPGQPPKLLIYATSNLESGIPARFSGSGSGTDFTLNIHPVEAEDAATYYCQQSYEDPYTFGGGTKLEIK

SEQ ID NO: 664 - DNA, 756 bp, Mus musculus
gaggtgcagctgctcgagcagtctggagctgaggtggttaggcctgggacttcagtgaagatgtcctgcaaggctgctggatacaccttcactaagtactggataggttgggtaaagcagaggcctggacatggccttgagtggattggagatattcaccctggaggtggttttgctaactacaatgagaagttcaagggcaaggccacactgactgcagacacatcctccagcacagcctacatgcagctcagcagactgacatctgatgactctgccatctattactgtgcaagatcgggttatgactacggtagtagttacgattaccatggtatggactactggggccaagggaccacggtcaccgtctcctcaggtggtggtggttctggcggcggcggctccggtggtggtggttctgagctccagatgacccagtctccaacttctttggctgtgtctctcgggcagagggccaccatctcctgcagggccagccaaactgtttactatgatggtaataattatatgaactggtatcaacacaaaccaggacagccacccaaactcctcatctatgctacatccaatctagaatctgggatcccagccaggtttagtggcagtgggtctgggacagacttcaccctcaacatccatcctgtggaggcggaggatgctgcaacctattactgtcagcaaagttatgaggatccgtacacgttcggaggggggaccaagcttgagatcaaa

SEQ ID NO: 665 - protein, 507 aa, Mus musculus
EVQLLEQSGAEVVRPGTSVKMSCKAAGYTFTKYWIGWVKQRPGHGLEWIGDIHPGGGFANYNEKFKGKATLTADTSSSTAYMQLSRLTSDDSAIYYCARSGYDYGSSYDYHGMDYWGQGTTVTVSSGGGGSGGGGSGGGGSELQMTQSPTSLAVSLGQRATISCRASQTVYYDGNNYMNWYQHKPGQPPKLLIYATSNLESGIPARFSGSGSGTDFTLNIHPVEAEDAATYYCQQSYEDPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 666 - DNA, 1521 bp, Mus musculus
gaggtgcagctgctcgagcagtctggagctgaggtggttaggcctgggacttcagtgaagatgtcctgcaaggctgctggatacaccttcactaagtactggataggttgggtaaagcagaggcctggacatggccttgagtggattggagatattcaccctggaggtggttttgctaactacaatgagaagttcaagggcaaggccacactgactgcagacacatcctccagcacagcctacatgcagctcagcagactgacatctgatgactctgccatctattactgtgcaagatcgggttatgactacggtagtagttacgattaccatggtatggactactggggccaagggaccacggtcaccgtctcctcaggtggtggtggttctggcggcggcggctccggtggtggtggttctgagctccagatgacccagtctccaacttctttggctgtgtctctcgggcagagggccaccatctcctgcagggccagccaaactgtttactatgatggtaataattatatgaactggtatcaacacaaaccaggacagccacccaaactcctcatctatgctacatccaatctagaatctgggatcccagccaggtttagtggcagtgggtctgggacagacttcaccctcaacatccatcctgtggaggcggaggatgctgcaacctattactgtcagcaaagttatgaggatccgtacacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 667 - protein, 126 aa, Mus musculus
EVQLLEQSGAELVRPGTSVKISCKATGYTFTTYWLGWVKQRPGHGLEWIGEIHPGGGYTNYNEKFKGKATLTADTSSSTAYMQLSRLTSDDSAIYYCARSGYDYGSSYDYYGMDYWGQGTTVTVSS

SEQ ID NO: 668 - protein, 5 aa, Mus musculus
TYWLG

SEQ ID NO: 669 - protein, 17 aa, Mus musculus
EIHPGGGYTNYNEKFKG

SEQ ID NO: 670 - protein, 16 aa, Mus musculus
SGYDYGSSYDYYGMDY

SEQ ID NO: 671 - DNA, 378 bp, Mus musculus
gaggtgcagctgctcgagcagtctggagctgaactggtaaggcctgggacctcagtgaagatttcctgcaaggctactggatacaccttcactacttactggctaggttgggtaaagcagaggcctggacatggccttgagtggattggagagattcaccctggaggtggttatactaactacaatgagaagttcaagggcaaggccacactgactgcagacacatcctccagcacagcctacatgcagctcagcagactgacatctgatgactccgccatctattactgtgcaagatcggggtatgactacggtagtagttacgattactatggtatggactactggggccaagggaccacggtcaccgtctcctca

SEQ ID NO: 672 - protein, 107 aa, Mus musculus
ELVMTQSPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLEIK

SEQ ID NO: 673 - protein, 11 aa, Mus musculus
RASQDIGSSLN

SEQ ID NO: 674 - protein, 7 aa, Mus musculus
ATSSLDS

SEQ ID NO: 675 - protein, 9 aa, Mus musculus
LQYASSPYT

SEQ ID NO: 676 - DNA, 321 bp, Mus musculus
gagctcgtcatgacccagtctccatcctccttatctgcctctctgggagaaagagtcagtctcacttgtcgggcaagtcaggacattggtagtagcttaaactggcttcagcaggaaccagatggaactattaaacgcctgatctacgccacatccagtttagattctggtgtccccaaaaggttcagtggcagtaggtctgggtcagattattctctcaccatcagcagccttgagtctgaagattttgtagactattactgtctacaatatgctagttctccgtacacgttcggaggggggaccaagcttgagatcaaa

SEQ ID NO: 677 - protein, 248 aa, Mus musculus
EVQLLEQSGAELVRPGTSVKISCKATGYTFTTYWLGWVKQRPGHGLEWIGEIHPGGGYTNYNEKFKGKATLTADTSSSTAYMQLSRLTSDDSAIYYCARSGYDYGSSYDYYGMDYWGQGTTVTVSSGGGGSGGGGSGGGGSELVMTQSPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLEIK

SEQ ID NO: 678 - DNA, 744 bp, Mus musculus
gaggtgcagctgctcgagcagtctggagctgaactggtaaggcctgggacctcagtgaagatttcctgcaaggctactggatacaccttcactacttactggctaggttgggtaaagcagaggcctggacatggccttgagtggattggagagattcaccctggaggtggttatactaactacaatgagaagttcaagggcaaggccacactgactgcagacacatcctccagcacagcctacatgcagctcagcagactgacatctgatgactccgccatctattactgtgcaagatcggggtatgactacggtagtagttacgattactatggtatggactactggggccaagggaccacggtcaccgtctcctcaggtggtggtggttctggcggcggcggctccggtggtggtggttctgagctcgtcatgacccagtctccatcctccttatctgcctctctgggagaaagagtcagtctcacttgtcgggcaagtcaggacattggtagtagcttaaactggcttcagcaggaaccagatggaactattaaacgcctgatctacgccacatccagtttagattctggtgtccccaaaaggttcagtggcagtaggtctgggtcagattattctctcaccatcagcagccttgagtctgaagattttgtagactattactgtctacaatatgctagttctccgtacacgttcggaggggggaccaagcttgagatcaaa

SEQ ID NO: 679 - protein, 503 aa, Mus musculus
EVQLLEQSGAELVRPGTSVKISCKATGYTFTTYWLGWVKQRPGHGLEWIGEIHPGGGYTNYNEKFKGKATLTADTSSSTAYMQLSRLTSDDSAIYYCARSGYDYGSSYDYYGMDYWGQGTTVTVSSGGGGSGGGGSGGGGSELVMTQSPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 680 - DNA, 1509 bp, Mus musculus
gaggtgcagctgctcgagcagtctggagctgaactggtaaggcctgggacctcagtgaagatttcctgcaaggctactggatacaccttcactacttactggctaggttgggtaaagcagaggcctggacatggccttgagtggattggagagattcaccctggaggtggttatactaactacaatgagaagttcaagggcaaggccacactgactgcagacacatcctccagcacagcctacatgcagctcagcagactgacatctgatgactccgccatctattactgtgcaagatcggggtatgactacggtagtagttacgattactatggtatggactactggggccaagggaccacggtcaccgtctcctcaggtggtggtggttctggcggcggcggctccggtggtggtggttctgagctcgtcatgacccagtctccatcctccttatctgcctctctgggagaaagagtcagtctcacttgtcgggcaagtcaggacattggtagtagcttaaactggcttcagcaggaaccagatggaactattaaacgcctgatctacgccacatccagtttagattctggtgtccccaaaaggttcagtggcagtaggtctgggtcagattattctctcaccatcagcagccttgagtctgaagattttgtagactattactgtctacaatatgctagttctccgtacacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 681 - protein, 126 aa, Mus musculus; identical to SEQ ID NO: 625

SEQ ID NO: 682 - protein, 5 aa, Mus musculus
KYWIG

SEQ ID NO: 683 - protein, 17 aa, Mus musculus
DIHPGGGFANYNEKFKG

SEQ ID NO: 684 - DNA, 16 bp, Mus musculus
sgydygssydyhgmdy

SEQ ID NO: 685 - protein, 378 aa, Mus musculus
GAGGTGCAGCTGCTCGAGCAGTCTGGAGCTGAGGTGGTTAGGCCTGGGACTTCAGTGAAGATGTCCTGCAAGGCTGCTGGATACACCTTCACTAAGTACTGGATAGGTTGGGTAAAGCAGAGGCCTGGACATGGCCTTGAGTGGATTGGAGATATTCACCCTGGAGGTGGTTTTGCTAACTACAATGAGAAGTTCAAGGGCAAGGCCACACTGACTGCAGACACATCCTCCAGCACAGCCTACATGCAGCTCAGCAGACTGACATCTGATGACTCTGCCATCTATTACTGTGCAAGATCGGGTTATGACTACGGTAGTAGTTACGATTACCATGGTATGGACTACTGGGGCCAAGGGACCACGGTCACCGTCTCCTCA

SEQ ID NO: 686 - protein, 113 aa, Mus musculus
ELVMTQSPSSLTVTAGEKVTMSCKSSQSLLNSGNQKNYLAWYQQKPGQPPKLLIYGASTRESGVPDRFTGSGSGTDFTLTISSVQAEDLADYFCQQHYSTPYTFGGGTKLEIK

SEQ ID NO: 687 - protein, 17 aa, Mus musculus
KSSQSLLNSGNQKNYLA

SEQ ID NO: 688 - protein, 7 aa, Mus musculus
GASTRES

SEQ ID NO: 689 - protein, 9 aa, Mus musculus
QQHYSTPYT

SEQ ID NO: 690 - DNA, 339 bp, Mus musculus
gagctcgtgatgacacagtctccatcctccctgactgtgacagcaggagagaaggtcactatgagctgcaagtccagtcagagtctgttaaacagtggaaatcaaaagaactacttggcctggtaccagcagaaaccagggcagcctcctaaactgttgatctacggggcatccactagggaatctggagtccctgatcgcttcacaggcagtggatctgggacagatttcactcttaccatcagcagtgtgcaggctgaagacctggcagattacttctgtcagcaacattatagcactccgtacacgttcggaggggggaccaagcttgagatcaaa

SEQ ID NO: 691 - protein, 254 aa, Mus musculus
EVQLLEQSGAEVVRPGTSVKMSCKAAGYTFTKYWIGWVKQRPGHGLEWIGDIHPGGGFANYNEKFKGKATLTADTSSSTAYMQLSRLTSDDSAIYYCARSGYDYGSSYDYHGMDYWGQGTTVTVSSGGGGSGGGGSGGGGSELVMTQSPSSLTVTAGEKVTMSCKSSQSLLNSGNQKNYLAWYQQKPGQPPKLLIYGASTRESGVPDRFTGSGSGTDFTLTISSVQAEDLADYFCQQHYSTPYTFGGGTKLEIK

SEQ ID NO: 692 - DNA, 762 bp, Mus musculus
gaggtgcagctgctcgagcagtctggagctgaggtggttaggcctgggacttcagtgaagatgtcctgcaaggctgctggatacaccttcactaagtactggataggttgggtaaagcagaggcctggacatggccttgagtggattggagatattcaccctggaggtggttttgctaactacaatgagaagttcaagggcaaggccacactgactgcagacacatcctccagcacagcctacatgcagctcagcagactgacatctgatgactctgccatctattactgtgcaagatcgggttatgactacggtagtagttacgattaccatggtatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttggcctggtaccagcagaaaccagggcagcctcctaaactgttgatctacggggcatccactagggaatctggagtccctgatcgcttcacaggcagtggatctgggacagatttcactcttaccatcagcagtgtgcaggctgaagacctggcagattacttctgtcagcaacattatagcactccgtacacgttcggaggggggaccaagcttgagatcaaa

SEQ ID NO: 693 - protein, 509 aa, Mus musculus
EVQLLEQSGAEVVRPGTSVKMSCKAAGYTFTKYWIGWVKQRPGHGLEWIGDIHPGGGFANYNEKFKGKATLTADTSSSTAYMQLSRLTSDDSAIYYCARSGYDYGSSYDYHGMDYWGQGTTVTVSSGGGGSGGGGSGGGGSELVMTQSPSSLTVTAGEKVTMSCKSSQSLLNSGNQKNYLAWYQQKPGQPPKLLIYGASTRESGVPDRFTGSGSGTDFTLTISSVQAEDLADYFCQQHYSTPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 694 - DNA, 1527 bp, Mus musculus
gaggtgcagctgctcgagcagtctggagctgaggtggttaggcctgggacttcagtgaagatgtcctgcaaggctgctggatacaccttcactaagtactggataggttgggtaaagcagaggcctggacatggccttgagtggattggagatattcaccctggaggtggttttgctaactacaatgagaagttcaagggcaaggccacactgactgcagacacatcctccagcacagcctacatgcagctcagcagactgacatctgatgactctgccatctattactgtgcaagatcgggttatgactacggtagtagttacgattaccatggtatggactactggggccaagggaccacggtcaccgtctcctcaggtggtggtggttctggcggcggcggctccggtggtggtggttctgagctcgtgatgacacagtctccatcctccctgactgtgacagcaggagagaaggtcactatgagctgcaagtccagtcagagtctgttaaacagtggaaatcaaaagaactacttggcctggtaccagcagaaaccagggcagcctcctaaactgttgatctacggggcatccactagggaatctggagtccctgatcgcttcacaggcagtggatctgggacagatttcactcttaccatcagcagtgtgcaggctgaagacctggcagattacttctgtcagcaacattatagcactccgtacacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 695 - protein, 126 aa, Mus musculus
EVQLLEQSGADLVRPGTSVKLSCKAAGYTFSRYWISWIRQRPGHGLEWIGEIYPGGGYGNYNENFKDKVTLTADTSSSTAYMQLSSLTSEDSAIYYCARSGYDYGSKYDYYGLDYWGQGTTVTVSS

SEQ ID NO: 696 - protein, 5 aa, Mus musculus
RYWIS

SEQ ID NO: 697 - protein, 17 aa, Mus musculus
EIYPGGGYGNYNENFKD

SEQ ID NO: 698 - protein, 16 aa, Mus musculus
SGYDYGSKYDYYGLDY

SEQ ID NO: 699 - DNA, 378 bp, Mus musculus
gaggtgcagctgctcgagcagtctggagctgacctggtaaggcctgggacttcagtgaagctgtcctgcaaggctgctggatacaccttcagtaggtattggataagttggataaggcagaggcctggacatggccttgagtggattggagaaatttaccctggaggtggttatggtaactacaatgagaatttcaaggacaaggtcacactgactgcagacacatcctccagcacagcctatatgcagctcagcagcctgacatctgaggactctgccatctattattgtgcaagatcggggtatgactacggcagtaagtacgattattatggtttggactactggggccaagggaccacggtcaccgtctcctca

SEQ ID NO: 700 - protein, 107 aa, Mus musculus
ELVMTQSPSSMYASLGERVTITCKASQDINSYLSWFQQKPGKSPKTLIYRANRLVDGVPSRFSGSGSGQDYSLTISSLEYEDMGIYYCLQYDAFPPTFGAGTKLEIK

SEQ ID NO: 701 - protein, 11 aa, Mus musculus
KASQDINSYLS

SEQ ID NO: 702 - protein, 7 aa, Mus musculus
RANRLVD

SEQ ID NO: 703 - protein, 9 aa, Mus musculus
LQYDAFPPT

SEQ ID NO: 704 - DNA, 321 bp, Mus musculus
gagctcgtgatgacacagtctccatcttccatgtatgcatctctaggagagagagtcactatcacttgcaaggcgagtcaggacattaatagctatttaagctggttccagcagaaaccagggaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgcgtttcctcccacgttcggtgctgggaccaagcttgagatcaaa

SEQ ID NO: 705 - protein, 248 aa, Mus musculus
EVQLLEQSGADLVRPGTSVKLSCKAAGYTFSRYWISWIRQRPGHGLEWIGEIYPGGGYGNYNENFKDKVTLTADTSSSTAYMQLSSLTSEDSAIYYCARSGYDYGSKYDYYGLDYWGQGTTVTVSSGGGGSGGGGSGGGGSELVMTQSPSSMYASLGERVTITCKASQDINSYLSWFQQKPGKSPKTLIYRANRLVDGVPSRFSGSGSGQDYSLTISSLEYEDMGIYYCLQYDAFPPTFGAGTKLEIK

SEQ ID NO: 706 - DNA, 744 bp, Mus musculus
gaggtgcagctgctcgagcagtctggagctgacctggtaaggcctgggacttcagtgaagctgtcctgcaaggctgctggatacaccttcagtaggtattggataagttggataaggcagaggcctggacatggccttgagtggattggagaaatttaccctggaggtggttatggtaactacaatgagaatttcaaggacaaggtcacactgactgcagacacatcctccagcacagcctatatgcagctcagcagcctgacatctgaggactctgccatctattattgtgcaagatcggggtatgactacggcagtaagtacgattattatggtttggactactggggccaagggaccacggtcaccgtctcctcaggtggtggtggttctggcggcggcggctccggtggtggtggttctgagctcgtgatgacacagtctccatcttccatgtatgcatctctaggagagagagtcactatcacttgcaaggcgagtcaggacattaatagctatttaagctggttccagcagaaaccagggaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgcgtttcctcccacgttcggtgctgggaccaagcttgagatcaaa

SEQ ID NO: 707 - protein, 503 aa, Mus musculus
EVQLLEQSGADLVRPGTSVKLSCKAAGYTFSRYWISWIRQRPGHGLEWIGEIYPGGGYGNYNENFKDKVTLTADTSSSTAYMQLSSLTSEDSAIYYCARSGYDYGSKYDYYGLDYWGQGTTVTVSSGGGGSGGGGSGGGGSELVMTQSPSSMYASLGERVTITCKASQDINSYLSWFQQKPGKSPKTLIYRANRLVDGVPSRFSGSGSGQDYSLTISSLEYEDMGIYYCLQYDAFPPTFGAGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 708 - DNA, 1509 bp, Mus musculus
gaggtgcagctgctcgagcagtctggagctgacctggtaaggcctgggacttcagtgaagctgtcctgcaaggctgctggatacaccttcagtaggtattggataagttggataaggcagaggcctggacatggccttgagtggattggagaaatttaccctggaggtggttatggtaactacaatgagaatttcaaggacaaggtcacactgactgcagacacatcctccagcacagcctatatgcagctcagcagcctgacatctgaggactctgccatctattattgtgcaagatcggggtatgactacggcagtaagtacgattattatggtttggactactggggccaagggaccacggtcaccgtctcctcaggtggtggtggttctggcggcggcggctccggtggtggtggttctgagctcgtgatgacacagtctccatcttccatgtatgcatctctaggagagagagtcactatcacttgcaaggcgagtcaggacattaatagctatttaagctggttccagcagaaaccagggaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgcgtttcctcccacgttcggtgctgggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 709 - protein, 126 aa, Mus musculus; identical to SEQ ID NO: 695

SEQ ID NO: 710 - protein, 5 aa, Mus musculus
RYWIS

SEQ ID NO: 711 - protein, 17 aa, Mus musculus
EIYPGGGYGNYNENFKD

SEQ ID NO: 712 - protein, 16 aa, Mus musculus
SGYDYGSKYDYYGLDY

SEQ ID NO: 713 - DNA, 378 bp, Mus musculus; identical to SEQ ID NO: 699

SEQ ID NO: 714 - protein, 107 aa, Mus musculus
ELVMTQSPSSLSASLGERVSLTCRASQEISGYLSWLQQKPDGTIKRLIYAASTLDSGVPKRFSGSRSGSDYSLTISSLESEDFADYYCLQYASSPYTFGGGTKLEIK

SEQ ID NO: 715 - protein, 11 aa, Mus musculus
RASQEISGYLS

SEQ ID NO: 716 - protein, 7 aa, Mus musculus
AASTLDS

SEQ ID NO: 717 - protein, 9 aa, Mus musculus
LQYASSPYT

SEQ ID NO: 718 - DNA, 321 bp, Mus musculus
gagctcgtcatgacccagtctccatcctccttatctgcctctctgggagaaagagtcagtctcacttgtcgggcaagtcaggaaattagtggttacttaagctggcttcagcagaaaccagatggaactattaaacgcctgatctacgccgcatccactttagattctggtgtcccaaaaaggttcagtggcagtaggtctgggtcagattattctctcaccatcagcagccttgagtctgaagattttgcagactattactgtctacaatatgctagttctccgtacacgttcggaggggggaccaagcttgagatcaaa

SEQ ID NO: 719 - protein, 248 aa, Mus musculus
EVQLLEQSGADLVRPGTSVKLSCKAAGYTFSRYWISWIRQRPGHGLEWIGEIYPGGGYGNYNENFKDKVTLTADTSSSTAYMQLSSLTSEDSAIYYCARSGYDYGSKYDYYGLDYWGQGTTVTVSSGGGGSGGGGSGGGGSELVMTQSPSSLSASLGERVSLTCRASQEISGYLSWLQQKPDGTIKRLIYAASTLDSGVPKRFSGSRSGSDYSLTISSLESEDFADYYCLQYASSPYTFGGGTKLEIK

SEQ ID NO: 720 - DNA, 744 bp, Mus musculus
gaggtgcagctgctcgagcagtctggagctgacctggtaaggcctgggacttcagtgaagctgtcctgcaaggctgctggatacaccttcagtaggtattggataagttggataaggcagaggcctggacatggccttgagtggattggagaaatttaccctggaggtggttatggtaactacaatgagaatttcaaggacaaggtcacactgactgcagacacatcctccagcacagcctatatgcagctcagcagcctgacatctgaggactctgccatctattattgtgcaagatcggggtatgactacggcagtaagtacgattattatggtttggactactggggccaagggaccacggtcaccgtctcctcaggtggtggtggttctggcggcggcggctccggtggtggtggttctgagctcgtcatgacccagtctccatcctccttatctgcctctctgggagaaagagtcagtctcacttgtcgggcaagtcaggaaattagtggttacttaagctggcttcagcagaaaccagatggaactattaaacgcctgatctacgccgcatccactttagattctggtgtcccaaaaaggttcagtggcagtaggtctgggtcagattattctctcaccatcagcagccttgagtctgaagattttgcagactattactgtctacaatatgctagttctccgtacacgttcggaggggggaccaagcttgagatcaaa

SEQ ID NO: 721 - protein, 503 aa, Mus musculus
EVQLLEQSGADLVRPGTSVKLSCKAAGYTFSRYWISWIRQRPGHGLEWIGEIYPGGGYGNYNENFKDKVTLTADTSSSTAYMQLSSLTSEDSAIYYCARSGYDYGSKYDYYGLDYWGQGTTVTVSSGGGGSGGGGSGGGGSELVMTQSPSSLSASLGERVSLTCRASQEISGYLSWLQQKPDGTIKRLIYAASTLDSGVPKRFSGSRSGSDYSLTISSLESEDFADYYCLQYASSPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 722 - DNA, 1509 bp, Mus musculus
gaggtgcagctgctcgagcagtctggagctgacctggtaaggcctgggacttcagtgaagctgtcctgcaaggctgctggatacaccttcagtaggtattggataagttggataaggcagaggcctggacatggccttgagtggattggagaaatttaccctggaggtggttatggtaactacaatgagaatttcaaggacaaggtcacactgactgcagacacatcctccagcacagcctatatgcagctcagcagcctgacatctgaggactctgccatctattattgtgcaagatcggggtatgactacggcagtaagtacgattattatggtttggactactggggccaagggaccacggtcaccgtctcctcaggtggtggtggttctggcggcggcggctccggtggtggtggttctgagctcgtcatgacccagtctccatcctccttatctgcctctctgggagaaagagtcagtctcacttgtcgggcaagtcaggaaattagtggttacttaagctggcttcagcagaaaccagatggaactattaaacgcctgatctacgccgcatccactttagattctggtgtcccaaaaaggttcagtggcagtaggtctgggtcagattattctctcaccatcagcagccttgagtctgaagattttgcagactattactgtctacaatatgctagttctccgtacacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 723 - protein, 126 aa, Mus musculus
EVQLLEQSGAELMKPGASVKISCKATGYTFSNYWIGWVKQRPGHGLEWIGDIYPGGSYTNYNEKFKGKVTLTADTSSRTAYMQLSSLTFEDSAIYYCARSGYDYASDYDYHGMDYWGQGTTVTVSS

SEQ ID NO: 724 - protein, 5 aa, Mus musculus
NYWIG

SEQ ID NO: 725 - protein, 17 aa, Mus musculus
DIYPGGSYTNYNEKFKG

SEQ ID NO: 726 - protein, 16 aa, Mus musculus
SGYDYASDYDYHGMDY

SEQ ID NO: 727 - DNA, 378 bp, Mus musculus
gaggtgcagctgctcgagcagtctggagctgagctgatgaagcctggggcctcagtgaagatatcctgcaaggctactggatacaccttcagtaattactggataggttgggtaaagcagaggcctggacatggccttgagtggattggagatatttaccctggaggtagttatactaactacaatgagaaattcaagggcaaggtcacactgactgcagacacatcctccaggacagcctacatgcagctcagcagcctgacatttgaggactctgccatctattactgtgcaagatcggggtatgactacgctagtgactacgattaccatggtatggactactggggccaagggaccacggtcaccgtctcctca

SEQ ID NO: 728 - protein, 107 aa, Mus musculus
ELVLTQSPSSMSASLGDRITITCQATQDIVKNLNWYQQKPGKPPSFLIYYATELAEGVPSRFSGSGSGSDYSLTISNLESEDFADYYCLQFYEFPYTFGGGTKLEIK

SEQ ID NO: 729 - protein, 11 aa, Mus musculus
QATQDIVKNLN

SEQ ID NO: 730 - protein, 7 aa, Mus musculus
YATELAE

SEQ ID NO: 731 - protein, 9 aa, Mus musculus
LQFYEFPYT

SEQ ID NO: 732 - DNA, 321 bp, Mus musculus
gagctcgtgctcacccagtctccatcctctatgtctgcatctctgggagacagaataaccatcacttgccaggcaactcaagacattgttaagaatttaaactggtatcagcagaaaccagggaaacccccttcattcctgatctattatgcaactgaactggcagaaggggtcccatcaaggttcagtggcagtgggtctgggtcagactattctctgacaatcagcaacctggagtctgaagattttgcagactattactgtctacagttttatgagtttccgtacacgttcggaggggggaccaagcttgagatcaaa

SEQ ID NO: 733 - protein, 248 aa, Mus musculus
EVQLLEQSGAELMKPGASVKISCKATGYTFSNYWIGWVKQRPGHGLEWIGDIYPGGSYTNYNEKFKGKVTLTADTSSRTAYMQLSSLTFEDSAIYYCARSGYDYASDYDYHGMDYWGQGTTVTVSSGGGGSGGGGSGGGGSELVLTQSPSSMSASLGDRITITCQATQDIVKNLNWYQQKPGKPPSFLIYYATELAEGVPSRFSGSGSGSDYSLTISNLESEDFADYYCLQFYEFPYTFGGGTKLEIK

SEQ ID NO: 734 - DNA, 744 bp, Mus musculus
gaggtgcagctgctcgagcagtctggagctgagctgatgaagcctggggcctcagtgaagatatcctgcaaggctactggatacaccttcagtaattactggataggttgggtaaagcagaggcctggacatggccttgagtggattggagatatttaccctggaggtagttatactaactacaatgagaaattcaagggcaaggtcacactgactgcagacacatcctccaggacagcctacatgcagctcagcagcctgacatttgaggactctgccatctattactgtgcaagatcggggtatgactacgctagtgactacgattaccatggtatggactactggggccaagggaccacggtcaccgtctcctcaggtggtggtggttctggcggcggcggctccggtggtggtggttctgagctcgtgctcacccagtctccatcctctatgtctgcatctctgggagacagaataaccatcacttgccaggcaactcaagacattgttaagaatttaaactggtatcagcagaaaccagggaaacccccttcattcctgatctattatgcaactgaactggcagaaggggtcccatcaaggttcagtggcagtgggtctgggtcagactattctctgacaatcagcaacctggagtctgaagattttgcagactattactgtctacagttttatgagtttccgtacacgttcggaggggggaccaagcttgagatcaaa

SEQ ID NO: 735 - protein, 503 aa, Mus musculus
EVQLLEQSGAELMKPGASVKISCKATGYTFSNYWIGWVKQRPGHGLEWIGDIYPGGSYTNYNEKFKGKVTLTADTSSRTAYMQLSSLTFEDSAIYYCARSGYDYASDYDYHGMDYWGQGTTVTVSSGGGGSGGGGSGGGGSELVLTQSPSSMSASLGDRITITCQATQDIVKNLNWYQQKPGKPPSFLIYYATELAEGVPSRFSGSGSGSDYSLTISNLESEDFADYYCLQFYEFPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 736 - DNA, 1509 bp, Mus musculus
gaggtgcagctgctcgagcagtctggagctgagctgatgaagcctggggcctcagtgaagatatcctgcaaggctactggatacaccttcagtaattactggataggttgggtaaagcagaggcctggacatggccttgagtggattggagatatttaccctggaggtagttatactaactacaatgagaaattcaagggcaaggtcacactgactgcagacacatcctccaggacagcctacatgcagctcagcagcctgacatttgaggactctgccatctattactgtgcaagatcggggtatgactacgctagtgactacgattaccatggtatggactactggggccaagggaccacggtcaccgtctcctcaggtggtggtggttctggcggcggcggctccggtggtggtggttctgagctcgtgctcacccagtctccatcctctatgtctgcatctctgggagacagaataaccatcacttgccaggcaactcaagacattgttaagaatttaaactggtatcagcagaaaccagggaaacccccttcattcctgatctattatgcaactgaactggcagaaggggtcccatcaaggttcagtggcagtgggtctgggtcagactattctctgacaatcagcaacctggagtctgaagattttgcagactattactgtctacagttttatgagtttccgtacacgttcggaggggggaccaagcttgagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 737 - protein, 124 aa, Artificial Sequence
  FA22A9-H
QVQLVQSGAEVKKPGASVKVSCKTSGYTFTEYTIHWVRQAPGQRLEWMGGINPNNGIPNYNQKFKGRVTITIDTSSSTAYMELSSLRSEDTAVYYCARRRIAYGYDEGHAMDYWGQGTLVTVSS

SEQ ID NO: 738 - protein, 5 aa, Artificial Sequence
  FA22A9-HCDR1
EYTIH

SEQ ID NO: 739 - protein, 17 aa, Artificial Sequence
  FA22A9-HCDR2
GINPNNGIPNYNQKFKG

SEQ ID NO: 740 - protein, 15 aa, Artificial Sequence
  FA22A9-HCDR3
RRIAYGYDEGHAMDY

SEQ ID NO: 741 - DNA, 372 bp, Artificial Sequence
  FA22A9-H
caggtgcagctggtccagtctggagctgaggtgaagaagcctggggcttcagtaaaggtgtcctgcaagacttctggatacacattcactgaatacaccatacactgggtgagacaggcccctggacagagacttgagtggatgggaggtattaatcctaacaatggtattcctaactacaatcagaagttcaagggcagggtcacaataactatagacacgtcctccagcaccgcctacatggagctcagcagcctgagatctgaggatactgcggtctattactgtgcaagaagaagaatcgcctatggttacgacgagggccatgctatggactactggggtcaaggaaccctggtcaccgtctcctca

SEQ ID NO: 742 - protein, 113 aa, Artificial Sequence
  FA22A9-L
DIVMTQTPLSLAVTVGETASMSCKSSQSLLYSRNQKNYLAWYLQKPGQSPQLLIYWASTRESGVPDRFSGSGSGTDFTLTISRVEAEDVGVYYCQQYFSYPLTFGGGTKVEIK

SEQ ID NO: 743 - protein, 17 aa, Artificial Sequence
  FA22A9-LCDR1
KSSQSLLYSRNQKNYLA

SEQ ID NO: 744 - protein, 7 aa, Artificial Sequence
  FA22A9-LCDR2
WASTRES

SEQ ID NO: 745 - protein, 9 aa, Artificial Sequence
  FA22A9-LCDR3
QQYFSYPLT

SEQ ID NO: 746 - DNA, 339 bp, Artificial Sequence
  FA22A9-L
gacatcgtgatgacacagactccactctccctagctgtgacagttggagagacggcttctatgagctgcaagtccagtcagagccttttatatagtcgtaatcaaaagaactacttggcctggtacctgcagaagccagggcagtctcctcaactgctgatttactgggcatccactagggaatctggggtccctgatcgcttctcaggcagtggatctgggacggatttcactctcacgatcagcagagtggaggctgaggacgtgggagtttattactgtcagcaatattttagctatccgctcacgttcggtggtgggaccaaggtggagatcaaa

SEQ ID NO: 747 - protein, 252 aa, Artificial Sequence
  FA22A9-HL
QVQLVQSGAEVKKPGASVKVSCKTSGYTFTEYTIHWVRQAPGQRLEWMGGINPNNGIPNYNQKFKGRVTITIDTSSSTAYMELSSLRSEDTAVYYCARRRIAYGYDEGHAMDYWGQGTLVTVSSGGGGSGGGGSGGGGSDIVMTQTPLSLAVTVGETASMSCKSSQSLLYSRNQKNYLAWYLQKPGQSPQLLIYWASTRESGVPDRFSGSGSGTDFTLTISRVEAEDVGVYYCQQYFSYPLTFGGGTKVEIK

SEQ ID NO: 748 - DNA, 756 bp, Artificial Sequence
  FA22A9-HL
caggtgcagctggtccagtctggagctgaggtgaagaagcctggggcttcagtaaaggtgtcctgcaagacttctggatacacattcactgaatacaccatacactgggtgagacaggcccctggacagagacttgagtggatgggaggtattaatcctaacaatggtattcctaactacaatcagaagttcaagggcagggtcacaataactatagacacgtcctccagcaccgcctacatggagctcagcagcctgagatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccactctccctagctgtgacagttggagagacggcttctatgagctgcaagtccagtcagagccttttatatagtcgtaatcaaaagaactacttggcctggtacctgcagaagccagggcagtctcctcaactgctgatttactgggcatccactagggaatctggggtccctgatcgcttctcaggcagtggatctgggacggatttcactctcacgatcagcagagtggaggctgaggacgtgggagtttattactgtcagcaatattttagctatccgctcacgttcggtggtgggaccaaggtggagatcaaa

SEQ ID NO: 749 - protein, 507 aa, Artificial Sequence
  FA22A9 HL x I2C HL
QVQLVQSGAEVKKPGASVKVSCKTSGYTFTEYTIHWVRQAPGQRLEWMGGINPNNGIPNYNQKFKGRVTITIDTSSSTAYMELSSLRSEDTAVYYCARRRIAYGYDEGHAMDYWGQGTLVTVSSGGGGSGGGGSGGGGSDIVMTQTPLSLAVTVGETASMSCKSSQSLLYSRNQKNYLAWYLQKPGQSPQLLIYWASTRESGVPDRFSGSGSGTDFTLTISRVEAEDVGVYYCQQYFSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 750 - DNA, 1521 bp, Artificial Sequence
  FA22A9 HL x I2C HL
caggtgcagctggtccagtctggagctgaggtgaagaagcctggggcttcagtaaaggtgtcctgcaagacttctggatacacattcactgaatacaccatacactgggtgagacaggcccctggacagagacttgagtggatgggaggtattaatcctaacaatggtattcctaactacaatcagaagttcaagggcagggtcacaataactatagacacgtcctccagcaccgcctacatggagctcagcagcctgagatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccactctccctagctgtgacagttggagagacggcttctatgagctgcaagtccagtcagagccttttatatagtcgtaatcaaaagaactacttggcctggtacctgcagaagccagggcagtctcctcaactgctgatttactgggcatccactagggaatctggggtccctgatcgcttctcaggcagtggatctgggacggatttcactctcacgatcagcagagtggaggctgaggacgtgggagtttattactgtcagcaatattttagctatccgctcacgttcggtggtgggaccaaggtggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 751 - protein, 124 aa, Artificial Sequence
  FA22C11-H
QVQLVQSGAEVKKPGASVKVSCKTSGYTFTEYTIHWVRQSPGQRLEWMGGINPNNGIPNYNQKFKGRVTITRDKSSSTAYMELSSLRSEDTAVYYCARRRIAYGYDEGHAMDYWGQGTLVTVSS

SEQ ID NO: 752 - protein, 5 aa, Artificial Sequence
  FA22C11-HCDR1
EYTIH

SEQ ID NO: 753 - protein, 17 aa, Artificial Sequence
  FA22C11-HCDR2
GINPNNGIPNYNQKFKG

SEQ ID NO: 754 - protein, 15 aa, Artificial Sequence
  FA22C11-HCDR3
RRIAYGYDEGHAMDY

SEQ ID NO: 755 - DNA, 372 bp, Artificial Sequence
  FA22C11-H
caggtgcagctggtccagtctggagctgaggtgaagaagcctggggcttcagtaaaggtgtcctgcaagacttctggatacacattcactgaatacaccatacactgggtgagacagtcccctggacagagacttgagtggatgggaggtattaatcctaacaatggtattcctaactacaatcagaagttcaagggcagggtcacaataactagagacaagtcctccagcaccgcctacatggagctcagcagcctgagatctgaggatactgcggtctattactgtgcaagaagaagaatcgcctatggttacgacgagggccatgctatggactactggggtcaaggaaccctggtcaccgtctcctca

SEQ ID NO: 756 - protein, 113 aa, Artificial Sequence
  FA22C11-L
DIVMTQTPLSLPVTVGEPASISCKSSQSLLYSRNQKNYLAWYLQKPGQSPQLLIYWASTRESGVPDRFSGSGSGTDFTLKISRVEAEDVGIYYCQQYFSYPLTFGGGTKVEIK

SEQ ID NO: 757 - protein, 17 aa, Artificial Sequence
  FA22C11-LCDR1
KSSQSLLYSRNQKNYLA

SEQ ID NO: 758 - protein, 7 aa, Artificial Sequence
  FA22C11-LCDR2
WASTRES

SEQ ID NO: 759 - protein, 9 aa, Artificial Sequence
  FA22C11-LCDR3
QQYFSYPLT

SEQ ID NO: 760 - DNA, 339 bp, Artificial Sequence
  FA22C11-L
gacatcgtgatgacacagactccactctccctacctgtgacagttggagagccggcttctatcagctgcaagtccagtcagagccttttatatagtcgtaatcaaaagaactacttggcctggtacctgcagaagccagggcagtctcctcaactgctgatttactgggcatccactagggaatctggggtccctgatcgcttctcaggcagtggatctgggacagacttcaccctcaagatctctcgtgtggaggcggaggatgttggaatctattactgtcagcaatattttagctatccgctcacgttcggtggtgggaccaaggtggagatcaaa

SEQ ID NO: 761 - protein, 252 aa, Artificial Sequence
  FA22C11-HL
QVQLVQSGAEVKKPGASVKVSCKTSGYTFTEYTIHWVRQSPGQRLEWMGGINPNNGIPNYNQKFKGRVTITRDKSSSTAYMELSSLRSEDTAVYYCARRRIAYGYDEGHAMDYWGQGTLVTVSSGGGGSGGGGSGGGGSDIVMTQTPLSLPVTVGEPASISCKSSQSLLYSRNQKNYLAWYLQKPGQSPQLLIYWASTRESGVPDRFSGSGSGTDFTLKISRVEAEDVGIYYCQQYFSYPLTFGGGTKVEIK

SEQ ID NO: 762 - DNA, 756 bp, Artificial Sequence
  FA22C11-HL
caggtgcagctggtccagtctggagctgaggtgaagaagcctggggcttcagtaaaggtgtcctgcaagacttctggatacacattcactgaatacaccatacactgggtgagacagtcccctggacagagacttgagtggatgggaggtattaatcctaacaatggtattcctaactacaatcagaagttcaagggcagggtcacaataactagagacaagtcctccagcaccgcctacatggagctcagcagcctgagatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccactctccctacctgtgacagttggagagccggcttctatcagctgcaagtccagtcagagccttttatatagtcgtaatcaaaagaactacttggcctggtacctgcagaagccagggcagtctcctcaactgctgatttactgggcatccactagggaatctggggtccctgatcgcttctcaggcagtggatctgggacagacttcaccctcaagatctctcgtgtggaggcggaggatgttggaatctattactgtcagcaatattttagctatccgctcacgttcggtggtgggaccaaggtggagatcaaa

SEQ ID NO: 763 - protein, 507 aa, Artificial Sequence
  FA22C11 HL x I2C HL
QVQLVQSGAEVKKPGASVKVSCKTSGYTFTEYTIHWVRQSPGQRLEWMGGINPNNGIPNYNQKFKGRVTITRDKSSSTAYMELSSLRSEDTAVYYCARRRIAYGYDEGHAMDYWGQGTLVTVSSGGGGSGGGGSGGGGSDIVMTQTPLSLPVTVGEPASISCKSSQSLLYSRNQKNYLAWYLQKPGQSPQLLIYWASTRESGVPDRFSGSGSGTDFTLKISRVEAEDVGIYYCQQYFSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 764 - DNA, 1521 bp, Artificial Sequence
  FA22C11 HL x I2C HL
caggtgcagctggtccagtctggagctgaggtgaagaagcctggggcttcagtaaaggtgtcctgcaagacttctggatacacattcactgaatacaccatacactgggtgagacagtcccctggacagagacttgagtggatgggaggtattaatcctaacaatggtattcctaactacaatcagaagttcaagggcagggtcacaataactagagacaagtcctccagcaccgcctacatggagctcagcagcctgagatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccactctccctacctgtgacagttggagagccggcttctatcagctgcaagtccagtcagagccttttatatagtcgtaatcaaaagaactacttggcctggtacctgcagaagccagggcagtctcctcaactgctgatttactgggcatccactagggaatctggggtccctgatcgcttctcaggcagtggatctgggacagacttcaccctcaagatctctcgtgtggaggcggaggatgttggaatctattactgtcagcaatattttagctatccgctcacgttcggtggtgggaccaaggtggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 765 - protein, 124 aa, Artificial Sequence
  FA22D8-H
QVQLVQSGAEVEKPGASVKVSCKASGYTFTEYTIHWVRQAPGQRLEWMGGINPNNGIPNYNQKFKGRATITIDTSSSTAYMELSSLTSEDTAVYYCARRRIAYGYDEGHAMDYWGQGTLVTVSS

SEQ ID NO: 766 - protein, 5 aa, Artificial Sequence
  FA22D8-HCDR1
EYTIH

SEQ ID NO: 767 - protein, 17 aa, Artificial Sequence
  FA22D8-HCDR2
GINPNNGIPNYNQKFKG

SEQ ID NO: 768 - protein, 15 aa, Artificial Sequence
  FA22D8-HCDR3
RRIAYGYDEGHAMDY

SEQ ID NO: 769 - DNA, 372 bp, Artificial Sequence
  FA22D8-H
caggtgcagctggtccagtctggagctgaggtggagaagcctggggcttcagtaaaggtgtcctgcaaggcttctggatacacattcactgaatacaccatacactgggtgagacaggcccctggacagagacttgagtggatgggaggtattaatcctaacaatggtattcctaactacaatcagaagttcaagggcagggccacaataactatagacacgtcctccagcaccgcctacatggagctcagcagcctgacatctgaggatactgcggtctattactgtgcaagaagaagaatcgcctatggttacgacgagggccatgctatggactactggggtcaaggaaccctggtcaccgtctcctca

SEQ ID NO: 770 - protein, 113 aa, Artificial Sequence
  FA22D8-L
DIVMTQTPLSLPVTVGEQASISCKSSQSLLYSRNQKNYLAWYLQKPGQSPKLLIYWASTRESGVPDRFSGSGSGTDFTLKISSVEAEDVGVYYCQQYFSYPLTFGGGTKVEIK

SEQ ID NO: 771 - protein, 17 aa, Artificial Sequence
  FA22D8-LCDR1
KSSQSLLYSRNQKNYLA

SEQ ID NO: 772 - protein, 7 aa, Artificial Sequence
  FA22D8-LCDR2
WASTRES

SEQ ID NO: 773 - protein, 9 aa, Artificial Sequence
  FA22D8-LCDR3
QQYFSYPLT

SEQ ID NO: 774 - DNA, 339 bp, Artificial Sequence
  FA22D8-L
gacatcgtgatgacacagactccactctccctacctgtgacagttggagagcaggcttctatcagctgcaagtccagtcagagccttttatatagtcgtaatcaaaagaactacttggcctggtacctgcagaagccagggcagtctcctaaactgctgatttactgggcatccactagggaatctggggtccctgatcgcttctcaggcagtggatctgggacggatttcactctcaagatcagcagtgtggaggctgaggatgttggagtctattactgtcagcaatattttagctatccgctcacgttcggtggtgggaccaaggtggagatcaaa

SEQ ID NO: 775 - protein, 252 aa, Artificial Sequence
  FA22D8-HL
QVQLVQSGAEVEKPGASVKVSCKASGYTFTEYTIHWVRQAPGQRLEWMGGINPNNGIPNYNQKFKGRATITIDTSSSTAYMELSSLTSEDTAVYYCARRRIAYGYDEGHAMDYWGQGTLVTVSSGGGGSGGGGSGGGGSDIVMTQTPLSLPVTVGEQASISCKSSQSLLYSRNQKNYLAWYLQKPGQSPKLLIYWASTRESGVPDRFSGSGSGTDFTLKISSVEAEDVGVYYCQQYFSYPLTFGGGTKVEIK

SEQ ID NO: 776 - DNA, 756 bp, Artificial Sequence
  FA22D8-HL
caggtgcagctggtccagtctggagctgaggtggagaagcctggggcttcagtaaaggtgtcctgcaaggcttctggatacacattcactgaatacaccatacactgggtgagacaggcccctggacagagacttgagtggatgggaggtattaatcctaacaatggtattcctaactacaatcagaagttcaagggcagggccacaataactatagacacgtcctccagcaccgcctacatggagctcagcagcctgacatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccactctccctacctgtgacagttggagagcaggcttctatcagctgcaagtccagtcagagccttttatatagtcgtaatcaaaagaactacttggcctggtacctgcagaagccagggcagtctcctaaactgctgatttactgggcatccactagggaatctggggtccctgatcgcttctcaggcagtggatctgggacggatttcactctcaagatcagcagtgtggaggctgaggatgttggagtctattactgtcagcaatattttagctatccgctcacgttcggtggtgggaccaaggtggagatcaaa

SEQ ID NO: 777 - protein, 507 aa, Artificial Sequence
  FA22D8 HL x I2C HL
QVQLVQSGAEVEKPGASVKVSCKASGYTFTEYTIHWVRQAPGQRLEWMGGINPNNGIPNYNQKFKGRATITIDTSSSTAYMELSSLTSEDTAVYYCARRRIAYGYDEGHAMDYWGQGTLVTVSSGGGGSGGGGSGGGGSDIVMTQTPLSLPVTVGEQASISCKSSQSLLYSRNQKNYLAWYLQKPGQSPKLLIYWASTRESGVPDRFSGSGSGTDFTLKISSVEAEDVGVYYCQQYFSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 778 - DNA, 1521 bp, Artificial Sequence
  FA22D8 HL x I2C HL
caggtgcagctggtccagtctggagctgaggtggagaagcctggggcttcagtaaaggtgtcctgcaaggcttctggatacacattcactgaatacaccatacactgggtgagacaggcccctggacagagacttgagtggatgggaggtattaatcctaacaatggtattcctaactacaatcagaagttcaagggcagggccacaataactatagacacgtcctccagcaccgcctacatggagctcagcagcctgacatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccactctccctacctgtgacagttggagagcaggcttctatcagctgcaagtccagtcagagccttttatatagtcgtaatcaaaagaactacttggcctggtacctgcagaagccagggcagtctcctaaactgctgatttactgggcatccactagggaatctggggtccctgatcgcttctcaggcagtggatctgggacggatttcactctcaagatcagcagtgtggaggctgaggatgttggagtctattactgtcagcaatattttagctatccgctcacgttcggtggtgggaccaaggtggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 779 - protein, 124 aa, Artificial Sequence
  FA22E8-H
QVQLVQSGAELVKPGASVKVSCKASGYTFTEYTIHWVRQAPGQRLEWMGGINPNNGIPNYNQKFKGRATITIDTSASTAYMELRSLRSEDTAVYYCARRRIAYGYDEGHAMDYWGQGTLVTVSS

SEQ ID NO: 780 - protein, 5 aa, Artificial Sequence
  FA22E8-HCDR1
EYTIH

SEQ ID NO: 781 - protein, 17 aa, Artificial Sequence
  FA22E8-HCDR2
GINPNNGIPNYNQKFKG

SEQ ID NO: 782 - protein, 15 aa, Artificial Sequence
  FA22E8-HCDR3
RRIAYGYDEGHAMDY

SEQ ID NO: 783 - DNA, 372 bp, Artificial Sequence
  FA22E8-H
caggtgcagctggtccagtctggagctgagctggtgaagcctggggcttcagtaaaggtgtcctgcaaggcttctggatacacattcactgaatacaccatacactgggtgagacaggcccctggacagagacttgagtggatgggaggtattaatcctaacaatggtattcctaactacaatcagaagttcaagggcagggccacaataactatagacacgtccgccagcaccgcctacatggagctccgcagcctgagatctgaggatactgcggtctattactgtgcaagaagaagaatcgcctatggttacgacgagggccatgctatggactactggggtcaaggaaccctggtcaccgtctcctca

SEQ ID NO: 784 - protein, 113 aa, Artificial Sequence
  FA22E8-L
DIVMTQTPLSLAVTPGEQASISCKSSQSLLYSRNQKNYLAWYLQKPGQSPQLLIYWASTRESGVPDRFSGSGFGTDFTLKISGVEAEDVGVYYCQQYFSYPLTFGGGTKVEIK

SEQ ID NO: 785 - protein, 17 aa, Artificial Sequence
  FA22E8-LCDR1
KSSQSLLYSRNQKNYLA

SEQ ID NO: 786 - protein, 7 aa, Artificial Sequence
  FA22E8-LCDR2
WASTRES

SEQ ID NO: 787 - protein, 9 aa, Artificial Sequence
  FA22E8-LCDR3
QQYFSYPLT

SEQ ID NO: 788 - DNA, 339 bp, Artificial Sequence
  FA22E8-L
gacatcgtgatgacacagactccactctccctagctgtgacacctggagagcaggcttctatcagctgcaagtccagtcagagccttttatatagtcgtaatcaaaagaactacttggcctggtacctgcagaagccagggcagtctcctcaactgctgatttactgggcatccactagggaatctggggtccctgatcgcttctcaggcagtggatttgggacggatttcactctcaagatcagcggagtggaggctgaggacgtgggagtttattactgtcagcaatattttagctatccgctcacgttcggtggtgggaccaaggtggagatcaaa

SEQ ID NO: 789 - protein, 252 aa, Artificial Sequence
  FA22E8-HL
QVQLVQSGAELVKPGASVKVSCKASGYTFTEYTIHWVRQAPGQRLEWMGGINPNNGIPNYNQKFKGRATITIDTSASTAYMELRSLRSEDTAVYYCARRRIAYGYDEGHAMDYWGQGTLVTVSSGGGGSGGGGSGGGGSDIVMTQTPLSLAVTPGEQASISCKSSQSLLYSRNQKNYLAWYLQKPGQSPQLLIYWASTRESGVPDRFSGSGFGTDFTLKISGVEAEDVGVYYCQQYFSYPLTFGGGTKVEIK

SEQ ID NO: 790 - DNA, 756 bp, Artificial Sequence
  FA22E8-HL
caggtgcagctggtccagtctggagctgagctggtgaagcctggggcttcagtaaaggtgtcctgcaaggcttctggatacacattcactgaatacaccatacactgggtgagacaggcccctggacagagacttgagtggatgggaggtattaatcctaacaatggtattcctaactacaatcagaagttcaagggcagggccacaataactatagacacgtccgccagcaccgcctacatggagctccgcagcctgagatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccactctccctagctgtgacacctggagagcaggcttctatcagctgcaagtccagtcagagccttttatatagtcgtaatcaaaagaactacttggcctggtacctgcagaagccagggcagtctcctcaactgctgatttactgggcatccactagggaatctggggtccctgatcgcttctcaggcagtggatttgggacggatttcactctcaagatcagcggagtggaggctgaggacgtgggagtttattactgtcagcaatattttagctatccgctcacgttcggtggtgggaccaaggtggagatcaaa

SEQ ID NO: 791 - protein, 507 aa, Artificial Sequence
  FA22E8 HL x I2C HL
QVQLVQSGAELVKPGASVKVSCKASGYTFTEYTIHWVRQAPGQRLEWMGGINPNNGIPNYNQKFKGRATITIDTSASTAYMELRSLRSEDTAVYYCARRRIAYGYDEGHAMDYWGQGTLVTVSSGGGGSGGGGSGGGGSDIVMTQTPLSLAVTPGEQASISCKSSQSLLYSRNQKNYLAWYLQKPGQSPQLLIYWASTRESGVPDRFSGSGFGTDFTLKISGVEAEDVGVYYCQQYFSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 792 - DNA, 1521 bp, Artificial Sequence
  FA22E8 HL x I2C HL
caggtgcagctggtccagtctggagctgagctggtgaagcctggggcttcagtaaaggtgtcctgcaaggcttctggatacacattcactgaatacaccatacactgggtgagacaggcccctggacagagacttgagtggatgggaggtattaatcctaacaatggtattcctaactacaatcagaagttcaagggcagggccacaataactatagacacgtccgccagcaccgcctacatggagctccgcagcctgagatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccactctccctagctgtgacacctggagagcaggcttctatcagctgcaagtccagtcagagccttttatatagtcgtaatcaaaagaactacttggcctggtacctgcagaagccagggcagtctcctcaactgctgatttactgggcatccactagggaatctggggtccctgatcgcttctcaggcagtggatttgggacggatttcactctcaagatcagcggagtggaggctgaggacgtgggagtttattactgtcagcaatattttagctatccgctcacgttcggtggtgggaccaaggtggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 793 - protein, 124 aa, Artificial Sequence
  FA20H3-H
QVQLVQSGAEVKKPGASVKMSCKTSGYTFTEYTIHWVRQAPGQRLEWMGGINPNNGIPNYNQKFKGRATITRDTSSSTAYMELSSLRSEDTAVYYCARRRIAYGYDEGHAMDYWGQGTLVTVSS

SEQ ID NO: 794 - protein, 5 aa, Artificial Sequence
  FA20H3-HCDR1
EYTIH

SEQ ID NO: 795 - protein, 17 aa, Artificial Sequence
  FA20H3-HCDR2
GINPNNGIPNYNQKFKG

SEQ ID NO: 796 - protein, 15 aa, Artificial Sequence
  FA20H3-HCDR3
RRIAYGYDEGHAMDY

SEQ ID NO: 797 - DNA, 372 bp, Artificial Sequence
  FA20H3-H
caggtgcagctggtccagtctggagctgaggtgaagaagcctggggcttcagtaaagatgtcctgcaagacttctggatacacattcactgaatacaccatacactgggtgagacaggcccctggacagagacttgagtggatgggaggtattaatcctaacaatggtattcctaactacaatcagaagttcaagggcagggccacaataactagagacacgtcctccagcaccgcctacatggagctcagcagcctgagatctgaggatactgcggtctattactgtgcaagaagaagaatcgcctatggttacgacgagggccatgctatggactactggggtcaaggaaccctggtcaccgtctcctca

SEQ ID NO: 798 - protein, 113 aa, Artificial Sequence
  FA20H3-L
DIVMTQTPFSLPVTPGEPASISCKSSQSLLYSRNQKNYLAWYQQKPGQSPQLLIYWASTRESGVPDRFSGSGSGTDFTLNISRVEAEDVGVYYCQQYFSYPLTFGGGTKVEIK

SEQ ID NO: 799 - protein, 17 aa, Artificial Sequence
  FA20H3-LCDR1
KSSQSLLYSRNQKNYLA

SEQ ID NO: 800 - protein, 7 aa, Artificial Sequence
  FA20H3-LCDR2
WASTRES

SEQ ID NO: 801 - protein, 9 aa, Artificial Sequence
  FA20H3-LCDR3
QQYFSYPLT

SEQ ID NO: 802 - DNA, 339 bp, Artificial Sequence
  FA20H3-L
gacatcgtgatgacacagactccattctccctacctgtgacacctggagagccggcttctatcagctgcaagtccagtcagagccttttatatagtcgtaatcaaaagaactacttggcctggtaccagcagaagccagggcagtctcctcaactgctgatttactgggcatccactagggaatctggggtccctgatcgcttctcaggcagtggatctgggacagacttcaccctcaatatctctcgtgtggaggcggaggatgttggagtctattactgtcagcaatattttagctatccgctcacgttcggtggtgggaccaaggtggagatcaaa

SEQ ID NO: 803 - protein, 252 aa, Artificial Sequence
  FA20H3-HL
QVQLVQSGAEVKKPGASVKMSCKTSGYTFTEYTIHWVRQAPGQRLEWMGGINPNNGIPNYNQKFKGRATITRDTSSSTAYMELSSLRSEDTAVYYCARRRIAYGYDEGHAMDYWGQGTLVTVSSGGGGSGGGGSGGGGSDIVMTQTPFSLPVTPGEPASISCKSSQSLLYSRNQKNYLAWYQQKPGQSPQLLIYWASTRESGVPDRFSGSGSGTDFTLNISRVEAEDVGVYYCQQYFSYPLTFGGGTKVEIK

SEQ ID NO: 804 - DNA, 756 bp, Artificial Sequence
  FA20H3-HL
caggtgcagctggtccagtctggagctgaggtgaagaagcctggggcttcagtaaagatgtcctgcaagacttctggatacacattcactgaatacaccatacactgggtgagacaggcccctggacagagacttgagtggatgggaggtattaatcctaacaatggtattcctaactacaatcagaagttcaagggcagggccacaataactagagacacgtcctccagcaccgcctacatggagctcagcagcctgagatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccattctccctacctgtgacacctggagagccggcttctatcagctgcaagtccagtcagagccttttatatagtcgtaatcaaaagaactacttggcctggtaccagcagaagccagggcagtctcctcaactgctgatttactgggcatccactagggaatctggggtccctgatcgcttctcaggcagtggatctgggacagacttcaccctcaatatctctcgtgtggaggcggaggatgttggagtctattactgtcagcaatattttagctatccgctcacgttcggtggtgggaccaaggtggagatcaaa

SEQ ID NO: 805 - protein, 507 aa, Artificial Sequence
  FA20H3 HL x I2C HL
QVQLVQSGAEVKKPGASVKMSCKTSGYTFTEYTIHWVRQAPGQRLEWMGGINPNNGIPNYNQKFKGRATITRDTSSSTAYMELSSLRSEDTAVYYCARRRIAYGYDEGHAMDYWGQGTLVTVSSGGGGSGGGGSGGGGSDIVMTQTPFSLPVTPGEPASISCKSSQSLLYSRNQKNYLAWYQQKPGQSPQLLIYWASTRESGVPDRFSGSGSGTDFTLNISRVEAEDVGVYYCQQYFSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 806 - DNA, 1521 bp, Artificial Sequence
  FA20H3 HL x I2C HL
caggtgcagctggtccagtctggagctgaggtgaagaagcctggggcttcagtaaagatgtcctgcaagacttctggatacacattcactgaatacaccatacactgggtgagacaggcccctggacagagacttgagtggatgggaggtattaatcctaacaatggtattcctaactacaatcagaagttcaagggcagggccacaataactagagacacgtcctccagcaccgcctacatggagctcagcagcctgagatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccattctccctacctgtgacacctggagagccggcttctatcagctgcaagtccagtcagagccttttatatagtcgtaatcaaaagaactacttggcctggtaccagcagaagccagggcagtctcctcaactgctgatttactgggcatccactagggaatctggggtccctgatcgcttctcaggcagtggatctgggacagacttcaccctcaatatctctcgtgtggaggcggaggatgttggagtctattactgtcagcaatattttagctatccgctcacgttcggtggtgggaccaaggtggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 807 - protein, 124 aa, Artificial Sequence
  FA19D12-H
QVQLVQSGAEVKKPGASVKVSCKASGYTFTEYTIHWVRQAHGQSLEWMGGINPNNGIPNYNQKFKGRVTITVDTSASTAYMELRSLRSEDTAVYYCARRRIAYGYDEGHAMDYWGQGTLVTVSS

SEQ ID NO: 808 - protein, 5 aa, Artificial Sequence
  FA19D12-HCDR1
EYTIH

SEQ ID NO: 809 - protein, 17 aa, Artificial Sequence
  FA19D12-HCDR2
GINPNNGIPNYNQKFKG

SEQ ID NO: 810 - protein, 15 aa, Artificial Sequence
  FA19D12-HCDR3
RRIAYGYDEGHAMDY

SEQ ID NO: 811 - DNA, 417 bp, Artificial Sequence
  FA19D12-H
caggtgcagctggtccagtctggagctgaggtgaagaagcctggggcttcagtaaaggtgtcctgcaaggcttctggatacacattcactgaatacaccatacactgggtgagacaggcccatggacagagccttgagtggatgggaggtattaatcctaacaatggtattcctaactacaatcagaagttcaagggcagggtcacaataactgtagacacgtccgccagcaccgcctacatggagctccgcagcctgagatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttct

SEQ ID NO: 812 - protein, 113 aa, Artificial Sequence
  FA19D12-L
DIVMTQTPFSLPVTPGEPASISCKSSQSLLYSRNQKNYLAWYQQKPGQSPKLLIYWASTRESGVPDRFSGSGSGTDFTLKISRVEAEDVGVYYCQQYFSYPLTFGGGTKVEIK

SEQ ID NO: 813 - protein, 17 aa, Artificial Sequence
  FA19D12-LCDR1
KSSQSLLYSRNQKNYLA

SEQ ID NO: 814 - protein, 7 aa, Artificial Sequence
  FA19D12-LCDR2
WASTRES

SEQ ID NO: 815 - protein, 9 aa, Artificial Sequence
  FA19D12-LCDR3
QQYFSYPLT

SEQ ID NO: 816 - DNA, 339 bp, Artificial Sequence
  FA19D12-L
gacatcgtgatgacacagactccattctccctacctgtgacacctggagagccggcttctatcagctgcaagtccagtcagagccttttatatagtcgtaatcaaaagaactacttggcctggtaccagcagaagccagggcagtctcctaaactgctgatttactgggcatccactagggaatctggggtccctgatcgcttctcaggcagtggatctgggacggatttcactctcaaaatctccagagtggaggctgaggacgtgggagtttattactgtcagcaatattttagctatccgctcacgttcggtggtgggaccaaggtggagatcaaa

SEQ ID NO: 817 - protein, 252 aa, Artificial Sequence
  FA19D12-HL
QVQLVQSGAEVKKPGASVKVSCKASGYTFTEYTIHWVRQAHGQSLEWMGGINPNNGIPNYNQKFKGRVTITVDTSASTAYMELRSLRSEDTAVYYCARRRIAYGYDEGHAMDYWGQGTLVTVSSGGGGSGGGGSGGGGSDIVMTQTPFSLPVTPGEPASISCKSSQSLLYSRNQKNYLAWYQQKPGQSPKLLIYWASTRESGVPDRFSGSGSGTDFTLKISRVEAEDVGVYYCQQYFSYPLTFGGGTKVEIK

SEQ ID NO: 818 - DNA, 756 bp, Artificial Sequence
  FA19D12-HL
caggtgcagctggtccagtctggagctgaggtgaagaagcctggggcttcagtaaaggtgtcctgcaaggcttctggatacacattcactgaatacaccatacactgggtgagacaggcccatggacagagccttgagtggatgggaggtattaatcctaacaatggtattcctaactacaatcagaagttcaagggcagggtcacaataactgtagacacgtccgccagcaccgcctacatggagctccgcagcctgagatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccattctccctacctgtgacacctggagagccggcttctatcagctgcaagtccagtcagagccttttatatagtcgtaatcaaaagaactacttggcctggtaccagcagaagccagggcagtctcctaaactgctgatttactgggcatccactagggaatctggggtccctgatcgcttctcaggcagtggatctgggacggatttcactctcaaaatctccagagtggaggctgaggacgtgggagtttattactgtcagcaatattttagctatccgctcacgttcggtggtgggaccaaggtggagatcaaa

SEQ ID NO: 819 - protein, 507 aa, Artificial Sequence
  FA19D12HL x I2C HL
QVQLVQSGAEVKKPGASVKVSCKASGYTFTEYTIHWVRQAHGQSLEWMGGINPNNGIPNYNQKFKGRVTITVDTSASTAYMELRSLRSEDTAVYYCARRRIAYGYDEGHAMDYWGQGTLVTVSSGGGGSGGGGSGGGGSDIVMTQTPFSLPVTPGEPASISCKSSQSLLYSRNQKNYLAWYQQKPGQSPKLLIYWASTRESGVPDRFSGSGSGTDFTLKISRVEAEDVGVYYCQQYFSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 820 - DNA, 1521 bp, Artificial Sequence
  FA19D12HL x I2C HL
caggtgcagctggtccagtctggagctgaggtgaagaagcctggggcttcagtaaaggtgtcctgcaaggcttctggatacacattcactgaatacaccatacactgggtgagacaggcccatggacagagccttgagtggatgggaggtattaatcctaacaatggtattcctaactacaatcagaagttcaagggcagggtcacaataactgtagacacgtccgccagcaccgcctacatggagctccgcagcctgagatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccattctccctacctgtgacacctggagagccggcttctatcagctgcaagtccagtcagagccttttatatagtcgtaatcaaaagaactacttggcctggtaccagcagaagccagggcagtctcctaaactgctgatttactgggcatccactagggaatctggggtccctgatcgcttctcaggcagtggatctgggacggatttcactctcaaaatctccagagtggaggctgaggacgtgggagtttattactgtcagcaatattttagctatccgctcacgttcggtggtgggaccaaggtggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 821 - protein, 124 aa, Artificial Sequence
  FA19D9-H
QVQLVQSGAEVKKPGASVKVSCKTSGYTFTEYTIHWVRQAPGQRLEWMGGINPNNGIPNYNQKFKGRATLTIDTSASTAYMELSSLTSEDTAVYYCARRRIAYGYDEGHAMDYWGQGTLVTVSS

SEQ ID NO: 822 - protein, 5 aa, Artificial Sequence
  FA19D9-HCDR1
EYTIH

SEQ ID NO: 823 - protein, 17 aa, Artificial Sequence
  FA19D9-HCDR2
GINPNNGIPNYNQKFKG

SEQ ID NO: 824 - protein, 15 aa, Artificial Sequence
  FA19D9-HCDR3
RRIAYGYDEGHAMDY

SEQ ID NO: 825 - DNA, 372 bp, Artificial Sequence
  FA19D9-H
caggtgcagctggtccagtctggagctgaggtgaagaagcctggggcttcagtaaaggtgtcctgcaagacttctggatacacattcactgaatacaccatacactgggtgagacaggcccctggacagagacttgagtggatgggaggtattaatcctaacaatggtattcctaactacaatcagaagttcaagggcagggccacattaactatagacacgtccgccagcaccgcctacatggagctcagcagcctgacatctgaggatactgcggtctattactgtgcaagaagaagaatcgcctatggttacgacgagggccatgctatggactactggggtcaaggaaccctggtcaccgtctcctca

SEQ ID NO: 826 - protein, 113 aa, Artificial Sequence
  FA19D9-L
DIVMTQTPLSLPVTPGEPASMSCKSSQSLLYSRNQKNYLAWFLQKPGQSPKLLIYWASTRESGVPDRFSGSGSGTDFTLKISRVEAEDVGVYYCQQYFSYPLTFGGGTKVEIK

SEQ ID NO: 827 - protein, 17 aa, Artificial Sequence
  FA19D9-LCDR1
KSSQSLLYSRNQKNYLA

SEQ ID NO: 828 - protein, 7 aa, Artificial Sequence
  FA19D9-LCDR2
WASTRES

SEQ ID NO: 829 - protein, 9 aa, Artificial Sequence
  FA19D9-LCDR3
QQYFSYPLT

SEQ ID NO: 830 - DNA, 339 bp, Artificial Sequence
  FA19D9-L
gacatcgtgatgacacagactccactctccctacctgtgacacctggagagccggcttctatgagctgcaagtccagtcagagccttttatatagtcgtaatcaaaagaactacttggcctggttcctgcagaagccagggcagtctcctaaactgctgatttactgggcatccactagggaatctggggtccctgatcgcttctcaggcagtggatctgggacggatttcactctcaagatcagcagagtggaggctgaggacgtgggagtttattactgtcagcaatattttagctatccgctcacgttcggtggtgggaccaaggtggagatcaaa

SEQ ID NO: 831 - protein, 252 aa, Artificial Sequence
  FA19D9-HL
QVQLVQSGAEVKKPGASVKVSCKTSGYTFTEYTIHWVRQAPGQRLEWMGGINPNNGIPNYNQKFKGRATLTIDTSASTAYMELSSLTSEDTAVYYCARRRIAYGYDEGHAMDYWGQGTLVTVSSGGGGSGGGGSGGGGSDIVMTQTPLSLPVTPGEPASMSCKSSQSLLYSRNQKNYLAWFLQKPGQSPKLLIYWASTRESGVPDRFSGSGSGTDFTLKISRVEAEDVGVYYCQQYFSYPLTFGGGTKVEIK

SEQ ID NO: 832 - DNA, 756 bp, Artificial Sequence
  FA19D9-HL
caggtgcagctggtccagtctggagctgaggtgaagaagcctggggcttcagtaaaggtgtcctgcaagacttctggatacacattcactgaatacaccatacactgggtgagacaggcccctggacagagacttgagtggatgggaggtattaatcctaacaatggtattcctaactacaatcagaagttcaagggcagggccacattaactatagacacgtccgccagcaccgcctacatggagctcagcagcctgacatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccactctccctacctgtgacacctggagagccggcttctatgagctgcaagtccagtcagagccttttatatagtcgtaatcaaaagaactacttggcctggttcctgcagaagccagggcagtctcctaaactgctgatttactgggcatccactagggaatctggggtccctgatcgcttctcaggcagtggatctgggacggatttcactctcaagatcagcagagtggaggctgaggacgtgggagtttattactgtcagcaatattttagctatccgctcacgttcggtggtgggaccaaggtggagatcaaa

SEQ ID NO: 833 - protein, 507 aa, Artificial Sequence
  FA19D9HL x I2C HL
QVQLVQSGAEVKKPGASVKVSCKTSGYTFTEYTIHWVRQAPGQRLEWMGGINPNNGIPNYNQKFKGRATLTIDTSASTAYMELSSLTSEDTAVYYCARRRIAYGYDEGHAMDYWGQGTLVTVSSGGGGSGGGGSGGGGSDIVMTQTPLSLPVTPGEPASMSCKSSQSLLYSRNQKNYLAWFLQKPGQSPKLLIYWASTRESGVPDRFSGSGSGTDFTLKISRVEAEDVGVYYCQQYFSYPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 834 - DNA, 1521 bp, Artificial Sequence
  FA19D9HL x I2C HL
caggtgcagctggtccagtctggagctgaggtgaagaagcctggggcttcagtaaaggtgtcctgcaagacttctggatacacattcactgaatacaccatacactgggtgagacaggcccctggacagagacttgagtggatgggaggtattaatcctaacaatggtattcctaactacaatcagaagttcaagggcagggccacattaactatagacacgtccgccagcaccgcctacatggagctcagcagcctgacatctgaggatactgcggtctattactgtgcaagaagaagaatcgcctatggttacgacgagggccatgctatggactactggggtcaaggaaccctggtcaccgtctcctcaggtggtggtggttctggcggcggcggctccggtggtggtggttctgacatcgtgatgacacagactccactctccctacctgtgacacctggagagccggcttctatgagctgcaagtccagtcagagccttttatatagtcgtaatcaaaagaactacttggcctggttcctgcagaagccagggcagtctcctaaactgctgatttactgggcatccactagggaatctggggtccctgatcgcttctcaggcagtggatctgggacggatttcactctcaagatcagcagagtggaggctgaggacgtgggagtttattactgtcagcaatattttagctatccgctcacgttcggtggtgggaccaaggtggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 835 - protein, 124 aa, Artificial Sequence
  IGF1R12-H
EVQLLESGGGLVQPGGSLRLSCAASGFTFSNYPMYWVRQAPGKGLEWVSRISSSGGRTVYADSVKGRFTISRDNSKNTLYLQMNSLRAEDTAVYYCARDRWSRSAAEYGLGGYWGQGTLVTVSS

SEQ ID NO: 836 - protein, 5 aa, Artificial Sequence
  IGF1R12-HCDR1
NYPMY

SEQ ID NO: 837 - protein, 17 aa, Artificial Sequence
  IGF1R12-HCDR2
RISSSGGRTVYADSVKG

SEQ ID NO: 838 - protein, 15 aa, Artificial Sequence
  IGF1R12-HCDR3
DRWSRSAAEYGLGGY

SEQ ID NO: 839 - DNA, 372 bp, Artificial Sequence
  IGF1R12-H
gaagtccagctccttgaaagcggtggcggattggtccagcctggaggctctttgagactctcctgtgccgcatcaggcttcaccttttccaactatcctatgtactgggttcgccaggctcctggaaaaggcttggaatgggtgtcacggattagctctagcgggggaaggactgtctatgccgattccgtgaaagggagattcaccatctctcgggacaatagcaagaacaccctgtatctccagatgaactctcttcgtgccgaagacactgccgtgtattactgcgcacgagaccgatggagccgatcagcagctgaatacggcttgggaggctactggggtcagggaactcttgtgactgtctctagc

SEQ ID NO: 840 - protein, 112 aa, Artificial Sequence
  IGF1R12-L
DIQMTQSPDSLAVSLGERATINCKSSQSVLYSSNNKNYLAWYQQKPGQPPKLLIYLASTRESGVPDRFSGSGSGTDFTLTISSLQAEDVAVYYCQQYYSTWTFGQGTKVEIK

SEQ ID NO: 841 - protein, 17 aa, Artificial Sequence
  IGF1R12-LCDR1
KSSQSVLYSSNNKNYLA

SEQ ID NO: 842 - protein, 7 aa, Artificial Sequence
  IGF1R12-LCDR2
LASTRES

SEQ ID NO: 843 - protein, 8 aa, Artificial Sequence
  IGF1R12-LCDR3
QQYYSTWT

SEQ ID NO: 844 - DNA, 336 bp, Artificial Sequence
  IGF1R12-L
gatatccagatgactcagagccctgattcactggcagtgtctctcggagaacgtgccacaatcaactgcaagagtagccagtccgtcctttactcctccaacaacaaaaactacctcgcatggtaccagcagaaacctgggcagccacccaaacttctcatctatcttgcttccacacgtgagagtggcgtgcctgaccgttttagcggatccggtagcggaacagatttcactctcacaatctcaagcctgcaggctgaagatgtcgcagtctactattgccagcagtattactcaacctggacattcggacaggggacaaaagtggagatcaaa

SEQ ID NO: 845 - protein, 251 aa, Artificial Sequence
  IGF1R12-HL
EVQLLESGGGLVQPGGSLRLSCAASGFTFSNYPMYWVRQAPGKGLEWVSRISSSGGRTVYADSVKGRFTISRDNSKNTLYLQMNSLRAEDTAVYYCARDRWSRSAAEYGLGGYWGQGTLVTVSSGGGGSGGGGSGGGGSDIQMTQSPDSLAVSLGERATINCKSSQSVLYSSNNKNYLAWYQQKPGQPPKLLIYLASTRESGVPDRFSGSGSGTDFTLTISSLQAEDVAVYYCQQYYSTWTFGQGTKVEIK

SEQ ID NO: 846 - DNA, 753 bp, Artificial Sequence
  IGF1R12-HL
gaagtccagctccttgaaagcggtggcggattggtccagcctggaggctctttgagactctcctgtgccgcatcaggcttcaccttttccaactatcctatgtactgggttcgccaggctcctggaaaaggcttggaatgggtgtcacggattagctctagcgggggaaggactgtctatgccgattccgtgaaagggagattcaccatctctcgggacaatagcaagaacaccctgtatctccagatgaactctcttcgtgccgaagacactgccgtgtattactgcgcacgagaccgatggagccgatcagcagctgaatacggcttgggaggctactggggtcagggaactcttgtgactgtctctagcggaggcggtggaagcgggggaggcggatctggtggaggcggaagcgatatccagatgactcagagccctgattcactggcagtgtctctcggagaacgtgccacaatcaactgcaagagtagccagtccgtcctttactcctccaacaacaaaaactacctcgcatggtaccagcagaaacctgggcagccacccaaacttctcatctatcttgcttccacacgtgagagtggcgtgcctgaccgttttagcggatccggtagcggaacagatttcactctcacaatctcaagcctgcaggctgaagatgtcgcagtctactattgccagcagtattactcaacctggacattcggacaggggacaaaagtggagatcaaa

SEQ ID NO: 847 - protein, 506 aa, Artificial Sequence
  IGF1R12HLxI2CHL
EVQLLESGGGLVQPGGSLRLSCAASGFTFSNYPMYWVRQAPGKGLEWVSRISSSGGRTVYADSVKGRFTISRDNSKNTLYLQMNSLRAEDTAVYYCARDRWSRSAAEYGLGGYWGQGTLVTVSSGGGGSGGGGSGGGGSDIQMTQSPDSLAVSLGERATINCKSSQSVLYSSNNKNYLAWYQQKPGQPPKLLIYLASTRESGVPDRFSGSGSGTDFTLTISSLQAEDVAVYYCQQYYSTWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 848 - DNA, 1518 bp, Artificial Sequence
  IGF1R12HLxI2CHL
gaagtccagctccttgaaagcggtggcggattggtccagcctggaggctctttgagactctcctgtgccgcatcaggcttcaccttttccaactatcctatgtactgggttcgccaggctcctggaaaaggcttggaatgggtgtcacggattagctctagcgggggaaggactgtctatgccgattccgtgaaagggagattcaccatctctcgggacaatagcaagaacaccctgtatctccagatgaactctcttcgtgccgaagacactgccgtgtattactgcgcacgagaccgatggagccgatcagcagctgaatacggcttgggaggctactggggtcagggaactcttgtgactgtctctagcggaggcggtggaagcgggggaggcggatctggtggaggcggaagcgatatccagatgactcagagccctgattcactggcagtgtctctcggagaacgtgccacaatcaactgcaagagtagccagtccgtcctttactcctccaacaacaaaaactacctcgcatggtaccagcagaaacctgggcagccacccaaacttctcatctatcttgcttccacacgtgagagtggcgtgcctgaccgttttagcggatccggtagcggaacagatttcactctcacaatctcaagcctgcaggctgaagatgtcgcagtctactattgccagcagtattactcaacctggacattcggacaggggacaaaagtggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaagactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 849 - protein, 120 aa, Artificial Sequence
  IGF1R24-H
EVQLVESGGELVQPGGSLRLSCAASGFTFSSYAMSWVRQAPGKGLEWVSRISPSGGSTYYADSVKGRFTISADTSKNTAYLQMNSLRAEDTAVYYCAREEYYYWGAMDVWGQGTLVTVSS

SEQ ID NO: 850 - protein, 5 aa, Artificial Sequence
  IGF1R24-HCDR1
SYAMS

SEQ ID NO: 851 - protein, 17 aa, Artificial Sequence
  IGF1R24-HCDR2
RISPSGGSTYYADSVKG

SEQ ID NO: 852 - protein, 11 aa, Artificial Sequence
  IGF1R24-HCDR3
EEYYYWGAMDV

SEQ ID NO: 853 - DNA, 360 bp, Artificial Sequence
  IGF1R24-H
gaagttcagctggtggaatccgggggagagcttgttcagcctggcggatcacttaggctgtcctgtgctgcaagcggcttcaccttctctagctatgccatgtcatgggtgcgacaggcccctggaaaaggactggagtgggtctcacgtatctctccaagtggcggatccacatactacgccgatagcgtgaaagggaggtttaccatttccgctgacacctccaagaacaccgcctacctgcagatgaactcactgagagccgaagacactgccgtgtactattgcgcacgggaggagtactactattggggagctatggacgtgtggggacagggaacattggtgactgtgtcttcc

SEQ ID NO: 854 - protein, 107 aa, Artificial Sequence
  IGF1R24-L
DIQMTQSPSSLSASVGDRVTITCRASQSISSYLAWYQQKPGKAPKLLIYGASSRASGVPSRFSGSGSGTDFTLTISSLQPEDFATYYCQQYYSSPLTFGQGTKVEIK

SEQ ID NO: 855 - protein, 11 aa, Artificial Sequence
  IGF1R24-LCDR1
RASQSISSYLA

SEQ ID NO: 856 - protein, 7 aa, Artificial Sequence
  IGF1R24-LCDR2
GASSRAS

SEQ ID NO: 857 - protein, 9 aa, Artificial Sequence
  IGF1R24-LCDR3
QQYYSSPLT

SEQ ID NO: 858 - DNA, 321 bp, Artificial Sequence
  IGF1R24-L
gatatccagatgacacagagcccaagctcactgagcgctagcgtcggagatagagtcaccatcacctgtagggcaagccagagcatctctagctacctggcatggtaccagcagaaacctggcaaggctcccaagctcctgatctacggcgcttcatctagagctagcggcgttccctcacgatttagcggaagcggaagcggaactgacttcaccctgaccatttcaagcctccagcctgaggatttcgccacctactactgccagcagtactactctagcccactcacatttgggcaggggacaaaggtggagatcaag

SEQ ID NO: 859 - protein, 242 aa, Artificial Sequence
  IGF1R24-HL
EVQLVESGGELVQPGGSLRLSCAASGFTFSSYAMSWVRQAPGKGLEWVSRISPSGGSTYYADSVKGRFTISADTSKNTAYLQMNSLRAEDTAVYYCAREEYYYWGAMDVWGQGTLVTVSSGGGGSGGGGSGGGGSDIQMTQSPSSLSASVGDRVTITCRASQSISSYLAWYQQKPGKAPKLLIYGASSRASGVPSRFSGSGSGTDFTLTISSLQPEDFATYYCQQYYSSPLTFGQGTKVEIK

SEQ ID NO: 860 - DNA, 726 bp, Artificial Sequence
  IGF1R24-HL
gaagttcagctggtggaatccgggggagagcttgttcagcctggcggatcacttaggctgtcctgtgctgcaagcggcttcaccttctctagctatgccatgtcatgggtgcgacaggcccctggaaaaggactggagtgggtctcacgtatctctccaagtggcggatccacatactacgccgatagcgtgaaagggaggtttaccatttccgctgacacctccaagaacaccgcctacctgcagatgaactcactgagagccgaagacactgccgtgtactattgcgcacgggaggagtactactattggggagctatggacgtgtggggacagggaacattggtgactgtgtcttccggtggcggaggaagcggaggtggcggaagcggaggcggtggaagcgatatccagatgacacagagcccaagctcactgagcgctagcgtcggagatagagtcaccatcacctgtagggcaagccagagcatctctagctacctggcatggtaccagcagaaacctggcaaggctcccaagctcctgatctacggcgcttcatctagagctagcggcgttccctcacgatttagcggaagcggaagcggaactgacttcaccctgaccatttcaagcctccagcctgaggatttcgccacctactactgccagcagtactactctagcccactcacatttgggcaggggacaaaggtggagatcaag

SEQ ID NO: 861 - protein, 497 aa, Artificial Sequence
  IGF1R24HLxI2CHL
EVQLVESGGELVQPGGSLRLSCAASGFTFSSYAMSWVRQAPGKGLEWVSRISPSGGSTYYADSVKGRFTISADTSKNTAYLQMNSLRAEDTAVYYCAREEYYYWGAMDVWGQGTLVTVSSGGGGSGGGGSGGGGSDIQMTQSPSSLSASVGDRVTITCRASQSISSYLAWYQQKPGKAPKLLIYGASSRASGVPSRFSGSGSGTDFTLTISSLQPEDFATYYCQQYYSSPLTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 862 - DNA, 1491 bp, Artificial Sequence
  IGF1R24HLxI2CHL
gaagttcagctggtggaatccgggggagagcttgttcagcctggcggatcacttaggctgtcctgtgctgcaagcggcttcaccttctctagctatgccatgtcatgggtgcgacaggcccctggaaaaggactggagtgggtctcacgtatctctccaagtggcggatccacatactacgccgatagcgtgaaagggaggtttaccatttccgctgacacctccaagaacaccgcctacctgcagatgaactcactgagagccgaagacactgccgtgtactattgcgcacgggaggagtactactattggggagctatggacgtgtggggacagggaacattggtgactgtgtcttccggtggcggaggaagcggaggtggcggaagcggaggcggtggaagcgatatccagatgacacagagcccaagctcactgagcgctagcgtcggagatagagtcaccatcacctgtagggcaagccagagcatctctagctacctggcatggtaccagcagaaacctggcaaggctcccaagctcctgatctacggcgcttcatctagagctagcggcgttccctcacgatttagcggaagcggaagcggaactgacttcaccctgaccatttcaagcctccagcctgaggatttcgccacctactactgccagcagtactactctagcccactcacatttgggcaggggacaaaggtggagatcaagtccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaagactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 863 - protein, 27 aa, Macaca fascicularis
QDGNEEMGSITQTPYQVSISGTTILTC

SEQ ID NO: 864 - protein, 27 aa, Macaca fascicularis
QDGNEEMGSITQTPYQVSISGTTVILT

SEQ ID NO: 865 - protein, 27 aa, Macaca mulatta
QDGNEEMGSITQTPYHVSISGTTVILT

The invention claimed is:

1. A method for identifying a bispecific single chain antibody that mediates T cell lysis of a target cell expressing human fibroblast activation protein alpha (FAPα) by binding to membrane proximal epitopes of human FAPα but does not mediate lysis of target cells expressing mouse FAPα, wherein said membrane proximal epitopes are epitopes formed only by amino acid residues of the extracellular domain of human FAPα, the alpha C-atom of which has a distance of less than 60 Å from the alpha C-atom of the $13^{th}$ amino acid residue as counted from the junction of transmembrane and extracellular region, the bispecific single chain antibody comprising a first binding domain capable of binding to an epitope of CD3 on the surface of a T cell and a second binding domain capable of binding to the extracellular domain of human FAPα, the method comprising the steps of:
  (a) providing
    (i) at least a first type of host cell expressing on the cell surface an extracellular domain of wild-type (wt) human FAPα comprising the amino acid sequence set forth in SEQ ID NO: 367, wherein said extracellular domain comprises the amino acid sequence set forth in SEQ ID NO: 448;
    (ii) at least a second type of host cell expressing on the cell surface a mutated form of said wt human FAPα, said mutated form comprising the amino acid sequence set forth in SEQ ID NO: 373, in which the amino acid sequence of said wt human FAPα is mutated at positions 144, 185, 186, 229, 267, 273, 274, 278, 284, 301, 328, 329, 331, 335 and 362 to comprise the amino acid residue found at each of these corresponding positions in wt murine FAPα comprising the amino acid sequence set forth in SEQ ID NO: 371; and
    (iii) at least a third type of host cell expressing on the cell surface wt murine FAPα comprising the amino acid sequence set forth in SEQ ID NO: 371;
  (b) contacting said at least first, second and third types of host cell with a bispecific single chain antibody comprising a first binding domain capable of binding to an epitope of CD3 on the surface of a T cell and a second binding domain capable of binding to the extracellular domain of human FAPα and an effector T cell; and
  (c) identifying a bispecific single chain antibody comprising a first binding domain capable of binding to an epitope of CD3 on the surface of a T cell and a second binding domain capable of binding to the extracellular domain of human FAPα that mediates lysis of said at least first and second types of host cell, but does not mediate lysis of said at least third type of host cell, thereby identifying a bispecific single chain antibody that mediates lysis of a target cell expressing human FAPα by binding to membrane proximal epitopes of human FAPα but does not mediate lysis of target cells expressing mouse FAPα.

2. The method of claim 1, wherein the target cell expressing human FAPα is a tumor cell.

3. The method of claim 1, wherein the target cell expressing human FAPα is a cancer cell.

4. The method of claim 3, wherein the cancer cell is an epithelial cell.

* * * * *